United States Patent 7,906,278 (DIAGNOSIS OF OSTEOARTHRITIS BY DETERMINATION OF ASPORIN RNA LEVELS) - sequence listing, part 4

SEQ ID NO: 24715 - DNA, 474 bp, Homo sapiens
  misc_feature 172: n = A,T,C or G
gctttttttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggnggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacgagaaaaactccttgtggtgaaggttctaagacgtgggatcgtttccagatgagaattcacaagcgactcattgacttgcacagtccttctgagattgttaagcagattacttccatcagtattgagccaggagttgaggggggaaagtcac

SEQ ID NO: 24716 - DNA, 487 bp, Homo sapiens
  misc_feature 1: n = A,T,C or G
natggccgggattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacattagtaggtgctcaacaaatttactgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgc

SEQ ID NO: 24717 - DNA, 485 bp, Homo sapiens
tatggccgggctatgaagagtttgtacaaatgatgacagcaaagtgaagaccttgtacagaatgtgttaaatttcttgtacaaagttgtttatttgccttttctttgtttgtaacttatctgtaaaaggtttctccctactgtcaaaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgccttttttaaaggtagttttctttaggaactgtcagcatgttgttgttgaagtgtgggagttgtaactctgcgtggactatggacagtcaacaatatgtacttaaaagttgcactattgcaaaacgggtgtattatcccg

SEQ ID NO: 24718 - DNA, 368 bp, Homo sapiens
  misc_feature 3, 12, 41: n = A,T,C or G
acnctccggccnttttggccggggcaagacacattctagtnaatttttgaaaactaaaaccgaaaaaggttgaaagcgatgagaaatgacaccctatgtatgttagtgaaacaagtaaaatgacagcatatttgtcatcagaaacaacaaaggccgaaaggaagtggcatagcatttttctagtgctgaaagaaaagaagaattaacccaaaattctacatccagtgaaaataacctttaggaatcaagggaaaatgaaaatattcttagacgaaagaaaactaagaaaatttgctgccagcaggcctactctcaataaatggccaatggatgttctctaaacaaaaagagaattctaaaacaatacc

SEQ ID NO: 24719 - DNA, 469 bp, Homo sapiens
  misc_feature 427, 429, 436, 461: n = A,T,C or G
ggggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggattggtttaagngntattaancagctcttgaagtctaaacactggnaagaatta

SEQ ID NO: 24720 - DNA, 498 bp, Homo sapiens
ctatggcccggggggcattgaggcagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatcttttaaaaagagattaaaccgaaggtgattaaaagacctt

SEQ ID NO: 24721 - DNA, 172 bp, Homo sapiens
  misc_feature 116: n = A,T,C or G
gtctcaaaaaaagaaaaaaaaaaatcccaagtggaagaggaagacagaaagaatgggtcagggagatgcaaggatggaagaagaggcaggagaaatgaggcctgagaagaactggnctcgccactgctggctttgaagacaaaggtttccaggtgccaagaaatggggtctc

SEQ ID NO: 24722 - DNA, 273 bp, Homo sapiens
  misc_feature 2, 5, 18, 39, 43, 272: n = A,T,C or G
tnctnaatgtgggtaccncagctgtatcactgcccaacntcanaaaacctgacggctatgattactatgccttttctaaagatcaatactataacattgatgtgcctagtagaacagcaagagcaattactactcgttctgggcagaccttatccaaagtctggcacaactgtccttagactgatgagcaaaggaggagtcaactaatgaagaaatgaataataaattttgacactgaaaaacattttattaataaagaatattggcatganc

SEQ ID NO: 24723 - DNA, 474 bp, Homo sapiens
atctatcctttacggcaagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagaggggagggagtgtgacttgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaaggaagaagactaagaaagttatagaatcagaggaaataacagaagaacattctgtttctgaaaatcaagagtcctcctcctcctcctcctcttcctcttcttcttcaacaattcggaaaatcaag

SEQ ID NO: 24724 - DNA, 483 bp, Homo sapiens
  misc_feature 110, 225, 252, 332: n = A,T,C or G
gcaataaagtttttggtgccctgagggagctgtggatggaggcttgtctatccctcacagtaccaaacgattccctggttatgattctgaaagcaaggaatttaatgcanaagtacatcggaagcacatcatgggccagaatgttgcagattacatgcgctacttaatggaagaagatgaagatgcttacaagaaacagttctctcaatacataaagaacagcgnaactccagacatgatggaggagatgtntaagaaagctcatgctgctatacgagagaatccagtctatgaaaagaagcccaagaaagaagttaaaaagaagaggtggnaccgtcccaaaatgtcccttgctcagaagaaggatcgggtagctcaaaagaaggcaagcttcctcagagctcaggagcgggctgctgagagctaaacccagtaattttctatgattttttcagatttagataattaaacctttttgaacag

SEQ ID NO: 24725 - DNA, 404 bp, Homo sapiens
  misc_feature 369: n = A,T,C or G
gtttaaagcctagttaacgcatttactaaacgcagacgaaaatggaaagattaattgggagtggtaggatgaaacaattcggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtnttggagaaattttagaagattagaaaaatataaag

SEQ ID NO: 24726 - DNA, 471 bp, Homo sapiens
aacagcctgtatagccaaacaatcctaagcaaaaagaacaaagctgcagtcatcacgctatttgacttcaaactatactacaaggctacagtaaccaaaacagcatgttattggtaccaaaatagatatatagaccaatggaacagaacagaggcctcagaaataacaccacacatctacaaccatctgatcttagacaaacctgacaaaaaacaagcaatggggaaaggattccctatttaataaatgggggttgggaaaactagctagccatatgcagagaactgcaactggacctcttcctttcaccttatacaaaaattagctcaagatggatcaaagacttaaacctaagacctaaaaccataaaaaccctagaagaaaaccttggcaataccattcaggacataggcatgggcaaagatttcatgactgaagcaccacaagcaatggcaataaaagccaaaatgg

SEQ ID NO: 24727 - DNA, 500 bp, Homo sapiens
  misc_feature 12, 14, 131: n = A,T,C or G
aatctccggccncntatggaccggggaggcattgaggcagccagcgcaggggcttctgctgagggggcaggcggagcttgaggaaaccgcagataagtttttttctctttgaaagatagagattaatacanctacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcgatgcttttagattaaaatgaaggtgacttaaacagcttaaagtttagtttaaaagttgtaggtgattaaaataattttggaaggcgatcttctaaaaagagattaaaccgaaggtga

SEQ ID NO: 24728 - DNA, 471 bp, Homo sapiens
  misc_feature 28, 461: n = A,T,C or G
gagcatttaagaagctcctctgccaagnaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagaccntagattctat

SEQ ID NO: 24729 - DNA, 349 bp, Homo sapiens
ataaaaggaatgaataatggcatttgcagcaacctggatggaactggagaccattattctaagtgaagtaactcaggaatggaaacccaaacatcatatgttctcactcataagtgggagctaagctatgaggatgcaaaggcataagaataatacaatgaacttcggggacttgggagaaagaatgggaggtgggtgaggaataaaagactacaaattgggttcagtgtatactgctcaggtgatggatgcaccacggtctcacaaatcaccactaaaatacttactcatgtaaccaaataccacctgtttcccaaaaaccaatggaaatgaaaaattaaaaaataat

SEQ ID NO: 24730 - DNA, 377 bp, Homo sapiens
  misc_feature 135: n = A,T,C or G
gagtactaacatggactaatctgtgggagcagtttattccagtatcacccagggtgcagccacaccaggactgtgttgaagggtgttttttttcttttaaatgtaatacctcctcatcttttcttcttacacagngtctgagaacatttacattatagataagtagtacatggtggataacttctacttttaggaggactactctcttctgacagtcctagactggtcttctacactaagacaccatgaaggagtgtgtgctcctattattcctggctttgtgctctgccaaacccttctttagcccttcacacatcgcactgaagaatatgatgctgaaggatttgggaagacacagatgatgatgatgatgatga

SEQ ID NO: 24731 - DNA, 481 bp, Homo sapiens
gaacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgcgatatttactaagaattgaacattcaaaaacccctggaagagactctttaagacctcaaaccatttagaatgggcaatgtattttacgctgtgttaaatgttaacaggttttccactatttctctttcttttctat

SEQ ID NO: 24732 - DNA, 110 bp, Homo sapiens
  misc_feature 13, 26, 33, 43, 57, 69, 76, 86, 90: n = A,T,C or G
catatgtggccangcgcagcgccttntgcctgnactcctaccncttcaggaaggccnaggaaggaaggnctgcttnagaccatcanttgnaggccagacacgccacacat

SEQ ID NO: 24733 - DNA, 248 bp, Homo sapiens
  misc_feature 22: n = A,T,C or G
cagtgagttcaccctctaaatnccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccct

SEQ ID NO: 24734 - DNA, 500 bp, Homo sapiens
  misc_feature 8, 9, 28: n = A,T,C or G
gcggccanngtggccggggagagaaganataaagattgaagaggagtttatggtgctgtgtcaactattaatgtttccttgggactagcacaggatgtatccacctggttaggagccccacactcctcaggccgtcatgtataaagcagttggctcatgaacttcatttttgtcaaattcctgttatcttatttaaatggtagtactggcttttagcattattgttattttgttttaaaaaaaacattcttaatgataattgtcaggaattgattttctgctcactacttcactaaattctaaaatgactattgcttagaggcagataaaatatcttgttctttaagaacaacgtcgagctatatacattgggaatatccctcacactgtttaaaaccatattgctttaagtggtgtataatgcaacattttattgaactattttgaaagtccctaatgtgcagattcacgtgaaattaccccatgtgtctagtttgcac

SEQ ID NO: 24735 - DNA, 489 bp, Homo sapiens
ggggcattcctgagctgacagcattcgggccgagatgtctcgctccgtggccttagctgtgctcgcgctaccctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaacccatgtgactttgtcacagcccaagatagttaagtgggatcgagacatgtaagcagcatcatggaggttttgaagatgccgcatttggatttggatgaattccaaattctgcttgcttgctttttaatattgatatgcttatacac

SEQ ID NO: 24736 - DNA, 483 bp, Homo sapiens
  misc_feature 431: n = A,T,C or G
tatggccggggaggcattgaggcagccagcgcaggggcttctgctgagggggcaggcggagcttgaggaaaccgcagataagtttttttctctttgaaaggtagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggngatttaaaataattttggaaggcgatcttttaaaaagagattaaaccgaagg

SEQ ID NO: 24737 - DNA, 354 bp, Homo sapiens
  misc_feature 329: n = A,T,C or G
atagttgatcaaattcaactgccttccccagataatgatacacgttaatgtgttttctgaatttctttactgatgctccagaaaggaagacaagttcatttttataattttatttttaatatttgtgttattgttgtcctcacgggaattaaatactatatatgaacactattaaaattcacaaaactactcaagtcaatgaaacacagtaacatgttcacagggacaagataaaatgactgtaactattgtcaggtgtcggaattgctttagccttttccataaatcatggtggaagtatcattatcatacatgattaatgacacttnacgtcgtggatctgattacaaccac

SEQ ID NO: 24738 - DNA, 424 bp, Homo sapiens
  misc_feature 420: n = A,T,C or G
gagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggntatg

SEQ ID NO: 24739 - DNA, 488 bp, Homo sapiens
ctagttatagatgcccaagtaaatctggtgggagggatggggagtgggaaaacagtatttgggagatatagccaccaacagcgatccaaccaagcaacccatatccttgcaaagttaacagtagtatctaccaatatccagagttccagcactggagatgcagacaaaaatgatatgcaaatatgcacacagatacaaatgacccttggggagggggtgggaaaaacaaacaaacaaaacagccctgggcgcagaggcaggatcccagtttaacaggaaatcagagctcacatctgtagcttgatgtatgtaacatatatgaaagatgagatctcagacacaataaacgagacaggaccaactggaactggcacttaaggttgcaactaaagagtagcaagtatagcatttgaaagtagaaattcttggagtcattccttgggtaatgtcaagaaaaacgtctggagcctgggcagtacctgaagatg

SEQ ID NO: 24740 - DNA, 128 bp, Homo sapiens
  misc_feature 7, 12: n = A,T,C or G
atttttnacccngggtattcggccttatggcgggggtatttttaatagagaaggagtttcgccatgttggtcaagctgatctcgaactcctggcctcaggtgatctgcctgcctcggcctcccgaagt

SEQ ID NO: 24741 - DNA, 412 bp, Homo sapiens
  misc_feature 2: n = A,T,C or G
tnggccgggggaggttgagatgaagcttcttctggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattattgggagtggtagggatgaaacaattcggagaagattagaagttttggaagtggaaaactggaagacagaagtacgggaaggcgaagaaaagaat

SEQ ID NO: 24742 - DNA, 102 bp, Homo sapiens
  misc_feature 13, 42: n = A,T,C or G
ggccgcaactctntgcttctctccagctctcaatgctgctgnattttcctctagtgcttccggatcctcttcattcttttcggctactcaaccactccgcat

SEQ ID NO: 24743 - DNA, 153 bp, Homo sapiens
  misc_feature 21, 32, 70, 81, 89, 107, 143: n = A,T,C or G
gttcttagtgtagggcacctnttcctttttcngaatgggtaggtttactaagaaaatcacatataaatcnaaacattgttncgggcctntcaagttatattcctatntagcccttctttcagtttttactttgggaattttgnggtaaagaat

SEQ ID NO: 24744 - DNA, 196 bp, Homo sapiens
  misc_feature 19: n = A,T,C or G
gaaagataaaagtatgtgnatttagcatctttctcaaaaagttaaaaagaatcaacaaaataaactgaaagtaagtggaagaaaaaaattgtaaagataaaaacagaagttgaaaagtgagaaaactgaaatatagtagaaataatatgtaaatccaaaacatggtcccataaaaacccaaccaaaagatctaacc

SEQ ID NO: 24745 - DNA, 210 bp, Homo sapiens
  misc_feature 13: n = A,T,C or G
gactgtggcctgncctcagtggtaccccacacatcagcactaccacaagaaccaacactgagcctcggaagctagatcacaggttaggggtttctctagatgggggttctgaaatttgcagtgtctgctcctgggaggcagcaccagaaagggcactgaaatgtactagctggatgtgacccagtcttaataaacaggttttctaatccg

SEQ ID NO: 24746 - DNA, 120 bp, Homo sapiens
  misc_feature 5, 17: n = A,T,C or G
cggcnttatggcgggangggtttttaaggaaacaaaactatttttttaatctcagatttatactagctatatggatattaggcatatctggtaattatgaatctagaatttttatttggg

SEQ ID NO: 24747 - DNA, 188 bp, Homo sapiens
  misc_feature 51, 98: n = A,T,C or G
ggcggcattggagtcaagatggaggagtacgcgcgagacccttgccatggngaattgtggatgactgtggtggggcctttacgatgggtaccattggnggtggtatctttcaagcaatcaaaggttttcgcaattctccagtgggagtaaaccacagactacgagggagtttgacagctattaaaaac

SEQ ID NO: 24748 - DNA, 480 bp, Homo sapiens
  misc_feature 1, 7, 37, 39, 58, 183, 204: n = A,T,C or G
ntttttnatccgggtaatttatgcctttatggcgggnancgcactgagatcaacaagnagatttataagattggccagggctaccttatcaaggacggcaagctgatcaagaacaatgcctccactgactatgacctatctgacaagagcatcaaccctctggggggctttgtccactatggngaagtgaccaatgactttgtnatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccacttgaagaaagaccgaattgcaaaggaagaaggagcttaatgccaggaacagattttgcagttgggggggtctcaataaaagttattttccactgg

SEQ ID NO: 24749 - DNA, 310 bp, Homo sapiens
aatattaaacaacatgaaactgcagtctgtttttgaaaatgagaatgtcctaagtgattcagaagagaggagggaagttgtgcactctgaaaatgcatgaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagtt

SEQ ID NO: 24750 - DNA, 470 bp, Homo sapiens
  misc_feature 417, 437: n = A,T,C or G
ggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatgggaggttttgnaagatgccgcatttggattnggatgaattccaaattctgcttgcttgcttttt

SEQ ID NO: 24751 - DNA, 475 bp, Homo sapiens
  misc_feature 4, 37: n = A,T,C or G
attnaaagctagcagaaggcaaaaaataactaagatngagcagaactgaaggagttagagacacaaaaaacccttcaaaaaatcagtgaatccaggagctggttttttgaaagggtcaacaaaattgatagactgctagcaagactaataaagaagaaaagagagaagaatcaaatagatgcaataaaaaatggtaaaggggatatcaccactgatcccatagaaatacaaactaccgttagagaatacggtaaacaactctacgcaaataaactagaaaatctagaagaaatggataaattcctcgacgcatacaccctcccaagactaaaccaggaagaagttgaatccctgcatagaccaataacaggctctgaaattgaggcaataattaatagcctaccaaccaaaaaaagtccaggaccagatggattcacagctgagttctaccagaggtacaagggggagctggtac

SEQ ID NO: 24752 - DNA, 473 bp, Homo sapiens
  misc_feature 319, 419, 435: n = A,T,C or G
aatggatgaatgtttctgatggggtgggtttctgtgcctagcacagggcaggtgtcaaatacgtgtttgttgagtggaagaaggaatcacatgatgatttagattgacagtaggtcaaaataatactcatttcttatgtacttttaggagtataggtgaaaataataggaacaatgcagaagaaaatccttttgaaagccttcccaaaatgttgactggaaaagagtttaaacttactcatttcaagctgctattgtatctctctctctctctctctctctctatctatctatatatatatagggaatttttaaaaaanacaccgaaagaatagaaacatatcaacactatacttaacacatgtactctgcattaggttttaattccatgaattcctattcattttttatttttatgcntgaaagtttactgggnaatgggaattcaccatccctgtttagattctgcattga

SEQ ID NO: 24753 - DNA, 491 bp, Homo sapiens
gtgttaggaaggcactagagtacgacagtgagctaagatctttttatttatttattttttatctttacttttttccaatgagctaagatctgaaaatgattttcatcatgcatttagctaaagcccaattaaaaagattgtagtagaccgtatatttagattcaggctgagaattatgataagatgtaataaatacacagatatgtatatttgttatgattcattttattcattcatttatttatttatttatttacttacttgataggctcaatcttataatttgtcagatgagactgcagagacttttggggctgagttgctgatgggctcacctactgttctaaagggaagcaacattctcccctctcaagtttcagaaaagggaaggcagccagagagtaatgcaaaaggctgtcccaggtggcagaatagaagggattgcactcagcatccccaaccctgtggatgcaggaagtacccttggcctc

SEQ ID NO: 24754 - DNA, 100 bp, Homo sapiens
  misc_feature 19: n = A,T,C or G
tatggccgggaagaaaaanataattacaccacacccaagtacaggatgatagttcgcgtgacaaacagagtacttcctgtgtgaagattgcttatgcccc

SEQ ID NO: 24755 - DNA, 486 bp, Homo sapiens
  misc_feature 197, 312: n = A,T,C or G
tatggccgggtgactggctccatttcatggaccaactgatcaattgccagtactaagccactcattgttatggcttcctttttgaaaaccacctgtctcaaggattcaggtttctgctcacatccccagctgatgctcaataaaactcagccaggagcatatggagatgctgacagccaggtaatgggtgagactgnggggtcccttttcctctaaagcctttactctgagggtaaggtcacaaagtagggtgtgacttgaaagtatcgtgaccatgtggcccaccagcagcctttccaaaggggaactccngagacatttcataatgcaaacagcactgttgctttaagaacaaggcctttggaggtggctaaacttgcacgcacgtgtgtgaaaagccatcccatcttctgcctccagttggagctttcagctgttaaaacagtcagaaactattgattcttccctttagggaaaaaaatgctc

SEQ ID NO: 24756 - DNA, 482 bp, Homo sapiens
  misc_feature 468: n = A,T,C or G
aatgtaaaatactaaataataatgaaccacagaagcttcttcatatcttaaagcaaatttattgaaaattgtggatttctactcgttaagtttgccactccattaattgaatgtttaataaatattacagtttaccaagatagtaattattatacttttcaataaaattacactttcataccacctattatgtgtccataaagcagttgtaccgtagtaaaataaaaaatataaactaagaccataacaaaacccctagtacatcccctagatgaacagcaagtaaaactttacacttctatggctatgttattatacatttattaactgaatagcagaaccattgacttcatgaaaaattggcaactgtattggaaaatatttaaacttgtttttaatgtcttaaatcagagtgaacaatttctgatccaagggcttaaattattccagacctttgtcatgctggtntattattttaaggg

SEQ ID NO: 24757 - DNA, 326 bp, Homo sapiens
  misc_feature 21, 34, 39, 274, 301: n = A,T,C or G
ggaccggggggaaaacagtancaagtactctgtncaagnaaagaaaaagaaagaaagaaaaagcaaagaaaggcaagcaaaaagcaaagcaaaggaagcaaaggaagaaaggaaggaaggaaggagagggagaagaagaagaagaaggagaaggagaagaagaagaagaagaagaaggagaaggagaagaaaaagaagaagaagaagaagagaaggaaggaaggaaggaaggaaggaaggaaggaaggaaggagaagaagaagaagaaggaganggagaagaagaagaagaagaagaaggngaaggagaagaaaaagaagaagaag

SEQ ID NO: 24758 - DNA, 448 bp, Homo sapiens
  misc_feature 9: n = A,T,C or G
atcacaagnaacacacacatatacgcgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatgc

SEQ ID NO: 24759 - DNA, 471 bp, Homo sapiens
  misc_feature 423: n = A,T,C or G
gtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaatattatatgtcaatatttaggtaaagcttttcttttttaatttccaggaaaaaataaaaagagtntgagtcttctgtaattcattgagcagttagctcatttgagataaagtc

SEQ ID NO: 24760 - DNA, 474 bp, Homo sapiens
  misc_feature 453, 456: n = A,T,C or G
gaaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggagggaaggaaagaacttgcatgttggtgaaggaagaagtggggnggnaaaaatggggggggggac

SEQ ID NO: 24761 - DNA, 499 bp, Homo sapiens
  misc_feature 5, 220: n = A,T,C or G
agggnaattgcggcccttatggaccggggaagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcngctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtcttccaaggcaggttctctcgaatactttga

SEQ ID NO: 24762 - DNA, 258 bp, Homo sapiens
gtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctt

SEQ ID NO: 24763 - DNA, 500 bp, Homo sapiens
  misc_feature 2, 8, 29, 41, 42, 119, 148, 243: n = A,T,C or G
anttgcgnccctctatggaccggggaggnattgaggcagcnnagcgcaggggcttctgctgagggggcaggcggagcttgaggaaaccgcagataagtttttttctctttgaaagatanagattaatacaactacttaaaaaatatantcaataggttactaagatattgcttagcgttaagtttttaacgtaattttaatagcttaagattttaagagaaaatatgaagacttagaagagtngcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtgat

SEQ ID NO: 24764 - DNA, 464 bp, Homo sapiens
  misc_feature 13: n = A,T,C or G
gcttttcacaagnatggcgccgaagcgaagaaggaagctcctgcccctcctaaagctgaagccaaagcgaaggctttaaaggccaagaaggcagtgttgaaaggcgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacatttgatgtggccaaggtcaacaccctgattcggcctgatggagagaaagaaggcatatgttcgactggctcctgattacgatgctttggatgttgcc

SEQ ID NO: 24765 - DNA, 234 bp, Homo sapiens
  misc_feature 99, 109, 126, 215, 222: n = A,T,C or G
gaccgggggaatgaacaagctcaggtattttcattcttatttttaggattttagtttttagtgtatggtacaaatgaacacagtttatattctaatacncttactgcanctcattttaatttttangatgcaagcacaatttactattcaaagtgagtagcaacatattcaacttgatcccattgtattcacttactcttgcccatgaaaaatgnccataantgaacagggcct

SEQ ID NO: 24766 - DNA, 402 bp, Homo sapiens
tatggccgggaagatctttttcttaagtgaaagcacctttaatttgctctaacggtacatcctgtaaagacagaattctgcatagccttttaggtgtttttacagtatgtgaaaaatacaagactcattctagagttaaattaccaatcttggttgatattatctgcctccatttttattaatttggaaattaatatgttgctagtaaatattggtttttacagtacccagtttgaaaatgtaagttatcaaaacttaatgtagtgaatttgtgtaaccatgttgtattgttgagaatgtatttttatttaaattttattttcttatcaagagtattataaaaattaacttttgtaactgtcgcttggaaataactcaaataaattacaagaagcctgtcac

SEQ ID NO: 24767 - DNA, 150 bp, Homo sapiens
  misc_feature 18, 48, 64, 104, 107: n = A,T,C or G
gaacataaaaatgcaagnatgaagcagcaagtgctgactgaggagctntagaaagctatccagnagatctagctaagatcactgatgaaaatgactcccccaancantggatttttaagtgcacgatgaaacagtctttataggaagaag

SEQ ID NO: 24768 - DNA, 469 bp, Homo sapiens
aaaaaagaaaactgcagactgatatctctgatgaacatagatgcaaatatccttaacaaaatactagctaactgaatccaacagcatatcaaagagataatccgtcatgattaagtgggtttcattccagggatgcagggatggtttaacttatgcaagtaaataaatttgatacaccacgtaaacagaattaaaaacaaaaatcacatgatcttctcaatagatacagaaaaacattttacaaattccagcattcctttaagattaaaaccctcagcaaaatcaacattcaagggacatgcctcaatgtaataaagtccacctatgacaaacccacagccaacataatactgcaaggggaaaagttgaaagcattccctctgagaactagaagaagacaaggatgcccactctcaccacttttattcaacatagtgctgggaagtcctagccagagcaatcatacagg

SEQ ID NO: 24769 - DNA, 395 bp, Homo sapiens
  misc_feature 5: n = A,T,C or G
caganaaaattcttagctgaaaggattcacaatttgattccacaactggatttctaggtaaaactatgggcaaactgaagattttatccagagggagccaaacaaagctgctgtgctatatgatgctgtcttctttatttgtcttttttatcatttattggattattaaactgaggtgatgcatgtaattgtgaatttggaatttgttccaacttaatggcttgcagtaccactttgataaaaatcagcatcaaaacattcctagtgttcaaatactgtggcattttccattgaaaattgctgaattttgcttattttataaatcacattagttaataccagtggtctttgaatactgtttcttaatgactcattttagcccctattttcagggg

SEQ ID NO: 24770 - DNA, 183 bp, Homo sapiens
accgggggtcggatgcattttgcctcaggggtataaaattaatttagaaatgacattttaaatagtggaagccttttatataatgatgtgaaaattattctgcttttgaaaatcaaaatcaaacatgaaacagtatgtctctctgtaaagaagtcagatatcttgttgggatattactttggc

SEQ ID NO: 24771 - DNA, 100 bp, Homo sapiens
  misc_feature 17: n = A,T,C or G
gatggcattgaggccgncagcgcaggggcttctgctgagggggcaggcggagcttgaggaaaccgcatataagtttttttctctttgaaagataacagat

SEQ ID NO: 24772 - DNA, 439 bp, Homo sapiens
  misc_feature 35: n = A,T,C or G
ggggcattcctgagctgacagcattcgggccgagnatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatga

SEQ ID NO: 24773 - DNA, 475 bp, Homo sapiens
gctaaacctagccccaaacccactccaccttactaccaggacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtaga

SEQ ID NO: 24774 - DNA, 479 bp, Homo sapiens
gagtgaaatttagtagccaagaaagaaggaaggaaggaaggagaaaacagctccctccaacagagacagagggaggggggattcaaacaaagagaaaacccctcgaatgagtttttaaaaagtaaaatacagagagattattatgtttaattttaattttaccaggctagaagcattaaccatgacttatttattctctgtactttgtatactttcattaatcaattaaacatgcttttctgtgagagaagcactaaactatttgttagaaaattctacataccaggcagggtacagtggctcacacctgtaatcccagcactttgggatgccagggcgggcggatcacctgaggtcaggagttcaagaccagcctggccaacatggtgaaaccccatctctactaaaaatacgaaaattagccgggcgtggtggccccgtgcctgtaatcccagctactcaggaggctgaggcaggag

SEQ ID NO: 24775 - DNA, 486 bp, Homo sapiens
  misc_feature 478: n = A,T,C or G
tatggccgggagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcgtctaccagctgcaggacgtcttcagtctgctgccagatgtcagcctgcanggagttcg

SEQ ID NO: 24776 - DNA, 485 bp, Homo sapiens
tatggccgggggattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatgccgcatttggattggatgaattccaaattctgcttgcttgctttttaatatttgat

SEQ ID NO: 24777 - DNA, 216 bp, Homo sapiens
atttgggagtttaatattctgatccaatatccaagaatttatccattccataaattctttctgtttagatgaatcaggattggtttctgtgccctgacaaattcaggtgttggtactatagtgagaattgtaggcagcatagagataagaggaatctagaattggttatcaggccttgtttggagataaaggcaattaaaaaatcatactaggagc

SEQ ID NO: 24778 - DNA, 281 bp, Homo sapiens
gggccaggtgcagtgtctccttgcgcctggccaataatatatttttacgtaagaatttgtgggacaactgaaacctgtgagaccagcctgggcaacatagggagaccccatctttacaaaaaataaaaaaatcagccaagcatgggggtgtgtgcctgtggtcccagctacttgggaggcagaagtgggaggatcccttgagcctaggaggttgaaactgcagtgagctgtgattgcaccactgcgctccagcctaggtgacagagcaagaacctgtctct

SEQ ID NO: 24779 - DNA, 402 bp, Homo sapiens
  misc_feature 2, 8, 27, 31: n = A,T,C or G
anggaccnggcatgtattagccatagntggngggaaggaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaagc

SEQ ID NO: 24780 - DNA, 189 bp, Homo sapiens
gggaaaagcatacggtataaagcacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgcc

SEQ ID NO: 24781 - DNA, 500 bp, Homo sapiens
tatggaccggggatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatct

SEQ ID NO: 24782 - DNA, 233 bp, Homo sapiens
tatggccggggcaaagtatgacctgtggtaagcaacctgggcatcttaggaagcagtccctggagaaggcatgttcccagagaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggccc

SEQ ID NO: 24783 - DNA, 266 bp, Homo sapiens
  misc_feature 201: n = A,T,C or G
aaaatttatacaagggttttaatgagaaaaaccttgtttgcaggaaggtgattgaaggaatgaacaagaatattgtgatgcatggaaagccattggattatcaggaagttgtagatatcattcaaagacatctgacaattaacatttgcataacactttacagtttgcaaactgctttcacatgtattatctaattccggngagctttcacagataaaaaaattgtctacctatcagggtgtcaaaaatgtaatgctgatcaatga

SEQ ID NO: 24784 - DNA, 421 bp, Homo sapiens
atcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttattttttgatagtcttacattacttgaattgttcaaagtacagtatatttta

SEQ ID NO: 24785 - DNA, 482 bp, Homo sapiens
tatggccggggaagtggtgggttacatcttgaagacagactgtgataagttagagatgtataatataaaccctaaaataaccactgaaatagcaaaataagttttaatcaataagccagtaaagaagataagaaatagaataataaaaagccacaaaattcaatccccaaaaaaagcttaaaaggagagaaaagaggaataggacacatggggaaaatagaaaacaaatagtaggttggtacatttaagtcatatcaaaatcatgttaaatataaatgatctaaaaacctcaattaaagggcagagattatcagattgcatgaaaaagtaggacccaactgtctgctgtgtatataaaattttttaaaaaataaagacaaatatgtttaaaagtaaaaattggattaaaagacacgagtctaacattaatcaaaagaaagatgtaatagctttcaacaggaaaactgcttgttagagcaaag

SEQ ID NO: 24786 - DNA, 181 bp, Homo sapiens
gttgacgcagtaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgat

SEQ ID NO: 24787 - DNA, 116 bp, Homo sapiens
  misc_feature 24, 28, 32: n = A,T,C or G
ttcaatgttgtctcatttggatgncagngctnttcacgaggtggacattgctcatatttaggtttgacctcagccccaaccaacatgtccatttgatactcgaatgcttgatcttc

SEQ ID NO: 24788 - DNA, 364 bp, Homo sapiens
  misc_feature 232: n = A,T,C or G
gaccgggggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttanaaaagccttgtaaatgcctatattgtgggcttttaacgtatttaagggaccacttaagacgagattagatgggctcttctggatttgttcctcatttgtcacaggtgtcttgtgattgaaaatcatgagcga

SEQ ID NO: 24789 - DNA, 340 bp, Homo sapiens
gagcagtgggagggtaccagcagaaagttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattggtgtg

SEQ ID NO: 24790 - DNA, 352 bp, Homo sapiens
tatggccgggaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaactt

SEQ ID NO: 24791 - DNA, 472 bp, Homo sapiens
  misc_feature 12, 271: n = A,T,C or G
atatgattcatnacataaacagaactaaagacagaaaccacatgattatttcaatagacgcagaaaaggccttcgataaaattcaacatcgcttcatgttaaaaactctcaatcaactaggtattgaaggaacatacctcaaagtaataagagccatatatggcaaaccaacatccagtgtcatgctgaatgggcaaaagctggaagcattccccttgaaatccagcacaaggcaaggatgctctctgccaccactcctatccaacatagnttgggaagttctggccagggcaatcagtcaaaagaaagaaataaaaggtattcagctaggaagaaaggaagtcaaattatcttttgtttgcagatgacatgattctacatctagaaaacccagtcctctcagcccaaaagattcttaagctgataagcaacttcagtctcagaatacaaaatcagtgtgcaaaaattgcta

SEQ ID NO: 24792 - DNA, 478 bp, Homo sapiens
  misc_feature 1, 22: n = A,T,C or G
natggccgggcttcattctganggagcttcacttggacaacaacaagccttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaaatcttgttaatgtcattgctaaaaaaataaataaaagctagatactggaaacctaactgcaatgtgggatgttttacccacatgacttattatgcataaagccaaatttccagtttaagtaattgcctacaataaaaagaaattttgcctgcc

SEQ ID NO: 24793 - DNA, 500 bp, Homo sapiens
tatggaccgggcaggctctgaaattgaggcaataattaatagcttaccaagcaaaaaatgtccagaaccagatggattcacagatgaattctaccagaggtacaaggaggagctcctcccattccttctgaaactattccaatcaatagaaaaagagggaatcctccctaactcattttatgaggccagcatgatcctaataccaaagcctggcagagacaccacaaaaaagagaattgtagaccaatatccctgatgaacatcgatgcaaaaatcctcaataaaatactggcaaaccgaatccagcagcacatcaaaaagcttatccaccatgatcaagtgggcttcatccctgggatgcaaggctggttcaacatacacaaatcaataaacataatccagcatataaacagaaccaaggacaaaaaccacatgattatctcaatagatgcagaaaaggcctttgacaaaattcaacaacccttcatgctaaaaactct

SEQ ID NO: 24794 - DNA, 310 bp, Homo sapiens
  misc_feature 38, 46, 159, 257, 258: n = A,T,C or G
gtctcttcacagtagaaatataatttttattttgttgnttttgccntattatcaacatctggggcagtgtctggcattgtgtgtccaataaacatttgttggataaatgattgagtggctacttggttgttcatatgttacatgctgtctttggaaggntactgtaaacatgaactggatttatcttggcaacattttaagaacatgtcttcctctacatacatatttgccttccctcatttttaaagaaaaccagnncaacaaaaggaaaatcaaggtctacctgaagagaccttgtgatatacaaagc

SEQ ID NO: 24795 - DNA, 152 bp, Homo sapiens
cagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcc

SEQ ID NO: 24796 - DNA, 422 bp, Homo sapiens
tatggccggggactttgaatgaggcaggttgcttatgaatgcagcctgaagtgtcactcagagatacttgcattgtgttatctttgattgacatgtctgggggttgtggaaaaatttcagcatatccaaatgtgcttctctaaacactgtctttacatgaacattttctccaagagaattggctcatgcccttatgatgatgatctgttattgcagtgttcactctcactgtaggcgaggtacatcctaaaagggtaggttcatgggacttgggaactcaggccgtgtttgcaattctgattcccacaagtctttggggctacaatttaactaatgtatcacattacctgccacctgcagagcttatctaacaagctaattactttgatgagaatacccgctgtaatatcctccaaaatgac

SEQ ID NO: 24797 - DNA, 266 bp, Homo sapiens
  misc_feature 6, 14: n = A,T,C or G
gaaagnaaaaaatnagtgttttacaaagcaaacttaactgaaaaagaaaagctattgcagagggtagggcaggaaaaagaagagacagtttcttctcattttgaaatgcgatgcccaataccaggagcgcttaataaagctagaacatgctgaggcaaagcaacatgaagatcaaagtaagataggtcatcttcaagaggagcttgaagaaaaaaacaagaaatattccttgatagtagcccagcatgtggaaaaagaaggaggga

SEQ ID NO: 24798 - DNA, 293 bp, Homo sapiens
  misc_feature 8, 21, 231: n = A,T,C or G
attggccncgggtgattaaantaatttgaaggcgatcttttaaaaagagattaaaccgaaggtgattaaaagaaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtncgggaaggcgaagaaaagaatagagaagatagggaaattagaagataaaaacatacttttag

SEQ ID NO: 24799 - DNA, 124 bp, Homo sapiens
  misc_feature 14, 32, 75, 82, 84: n = A,T,C or G
atggaccggggttnttatattaaaatgaaggngacttaaacagcttaaagtttagtttaaaagttgtaggtgatnaaaatantntgaaggcgatcttttaaaaagagattaaaccggaggtgat

SEQ ID NO: 24800 - DNA, 440 bp, Homo sapiens
agctcactgcaatttccgcctcccaggttcaagtgattctcccacctctgacctcaagtgatctgcccgcctcagcctcccaaggtgctgggatgacaggcatgagccaccgcgcccagctagatgatggctttttaaactagtcttctcatttctaattttgatttcttagtatttccctaagaactttttctaagaataccaatatgaaaggtgaagtactcttagaagtggcatgggtacattcaggtacagttctcaaaagaactaaaaccaccttatttgctttgcaaatagtaaatgttcgctaccagtgtaatacagaagtgaggagaatgggtgagattatttttttcatagctcttcctttgtttatggtaatcaggctttgcattctaaaaatgtttcaggttatatgtgcatttcagtttctattctgg

SEQ ID NO: 24801 - DNA, 372 bp, Homo sapiens
  misc_feature 2, 5, 322, 368, 371: n = A,T,C or G
cntanatggaccggggaagactactcgcacaattttaatattataaatgtataatgtaaatgtaattaagatttgtataatgtacgatgtactttggtaaataaaagtatgctgtgaataaatacgtatgatacaattcaaaattttacataaatatgtgataaaatttagctcatattctttttttttctttgagacggagtctcactctgttgcacccaggctagagtgcagcagcatgatctcagctcactgcaacctctacctcctgggttcaaacaattctcctgcctcagcctcctgagtagctgggattacaggngcccgccaccatgcccagctaatttttttctatttttggtggtggnggng

SEQ ID NO: 24802 - DNA, 455 bp, Homo sapiens
  misc_feature 6, 428: n = A,T,C or G
aggtcncgcctagtttgattttgttattaatattgttttaaaaaatgcctttttctgcctttggtaaactaaaggtctaacatatattccaacttcttttgacagaggaaaagacaagcatacgaatctaaccttatctgtcatggcctgcagttagaagcaacaagatcagtaagtactggtcccttttcagccctcggctgaccactgttctcgggcagcttcgtgccacttggaatacttgggtgacattggaaacatgcagccctggccacatcttagtcatagactgggagaggagtcaatcaaaatctgcattgtgtaggatgtattctttttttctgatcaaaactagcagatcttttttaatagccaacgaattttacaatgaatgcatgtatgaatgattatttttcttttctttaaanaaacttctaaaagcttttttgttattc

SEQ ID NO: 24803 - DNA, 387 bp, Homo sapiens
  misc_feature 384: n = A,T,C or G
tacaattgttgggaaaaggaagcaatgcagacacgagaaggagggctcagccttgctgggacactttcttttgtgtttacatcatgccaggggcttcattcagggtgtctgtgctctgactgcaatttttctttttttgcaaatgccactcgactgccttcataagcgtccataggatatctgaggaacattcatcaaaaataagccatagacatgaacaacacctcactaccccattgaagacgcatcacctagttaacctgctgcagtttttacatgatagactttgttccagattgacaagtcatctttcagttatttcctctgtcacttcaaaactccagcttgcccaataaggatttagaaccagagtgactgatatanttt

SEQ ID NO: 24804 - DNA, 471 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggt

SEQ ID NO: 24805 - DNA, 498 bp, Homo sapiens
  misc_feature 35: n = A,T,C or G
tatggaccggggtcccagaatctactttgcaaagngagcattttcacttgtcagcttaaatttctgactagaactaacatttgtgtatttttgtgcttagtcggaatacaaatttcacagtggatttttgaagtttgtccttaaattggataaaatcaagtgattaaagttactaaagagataaaaatggtaatttccatttttaaaagtaatttggttgtgtttatagttatttgtacaagtatttatcacagactctaaattgaaaaatgtagtatgatctatatttgaccctaaaaatgttggattaatttaacaaatatggcagatttttcataactaagtcttaagtcttctaaaaggaagctgttacccttctgtttttaattacattaattgaaatgtgttttaagagatacaatttcagcatattttatatattaaaaaacaaaaaaggattagtattgagccagtggccaaaaggtaatattactacca

SEQ ID NO: 24806 - DNA, 238 bp, Homo sapiens
agatttcacctgggagaacctctttttctccctcgactcttcctacgtaaactcccacccctgacttaccctggaggaggggtgaccgccacctgatgggattgcacggtttgggtattcttaatgaccaggcaaatgccttaagtaaacaaacaagaaatgtcttaattatacaccccacgtaaatacgggtttcttacattagaggatgtatttatataattatttgttaaattgt

SEQ ID NO: 24807 - DNA, 465 bp, Homo sapiens
ggctccggaagcctgcgagttccggaagccttggtaatccaggattcggctaggaaaagacaagctttccagagaatgtttcagagaaagttacgtggagcgtgggcgtttcgcagactcataagtggtctggaacctaacctgcagtgtctctgagcttctggcaagtatgaggcgaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttat

SEQ ID NO: 24808 - DNA, 465 bp, Homo sapiens
  misc_feature 20, 394: n = A,T,C or G
gtatatattacccttaagtnttttcctgtcttcactaatttagcaatgcattcatattagctgatgaaaataggcactcacaatgacaaccagagccagtttcttgtcttttttatacattttgtcatcccagagacaatcagtatgtgcttacctgtgttcaagtagagaaaaatacagtagagtctgataggacatattctcgtaccacagacaaaacaaatcttatgttgcatttactatcaactgctgctaatacgttattataaaacttacctagctcctgaattcttcctatcttatagcttaaaaaaattaggatcataggcaaatcagttaccttgcagaaagagctttgtatgacagacattgtcttattttatttctgtaaaanttagcctgtatgaatatgattttaattaacaagaaaacatttcttcctgattgacaacagtgttagacaag

SEQ ID NO: 24809 - DNA, 480 bp, Homo sapiens
ccttatggccgggggtagtaaacctatgtttccttcccctttgtatatcttcccccagtatttagaacaagggttccatctcctggctggccatgtcttctgtgtaatgggaagagatgagatcattcaccaggtagttggttcagtgtgcagttgggaagacactgtgggttagagaaggcagataggaaactccttgtaggagtggaaagcattgagagggattctgacatttctttcttagagaacagggcctgtgtaaaggatgctcaactattcagcagtcttaatccaattcttgctttagacataagccgtttatctttctttcataatgaaagcatatattttcaaattccagatgcaatgtcataagataaagaagctgaaattagagtgcccagcaaatagatttttcatttgctttgaactaaactttaataacccatgacctccgacctaactgaatattctctcatt

SEQ ID NO: 24810 - DNA, 319 bp, Homo sapiens
tctgttgatgttaactgagctactagaagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatt

SEQ ID NO: 24811 - DNA, 472 bp, Homo sapiens
tacttccatgaattttaaaatctgagggaaatgttttgtaaacatttatttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataaagaatttgcatacttacctagtgaaacttttctagaattatttttcactctaagtcatgtatgtttct

SEQ ID NO: 24812 - DNA, 252 bp, Homo sapiens
  misc_feature 15: n = A,T,C or G
ggagaaggaactagnaaaaacaattctggtaatatgacaaaacaaagttctttaacacccccaaataatcacactagttcaccagcaatggatccaaacaaaaaagaaatccgtgatttacctgaaaaagaattcaaaaggtcagctattaacctaatcaagaaggcatcatagaaaggtgaagttcaatttaaggaaatcaaaaaaatgatacaagaaatgagaagagacatcttcagtgaaatatatagc

SEQ ID NO: 24813 - DNA, 489 bp, Homo sapiens
ggatttataaagggcattgccgatactttttgactgtgtaaattaagttaattttttgtatgatgtacagtttgtttaaccttagagcttctatagatttctactttattatacttgaatgaggcagaaaagcactgtggaaaatctgtagctctggatgcaacatgcagacataccaaaaaaataataataaagcaaggtactgaagagcaatgttaacagaatgctttatatccagaatgctatgtttttttcaagccacattttagttgaatgaagtaaagttattcaatcttttattttaaaatattgagaaagtcacaaatgattacctctttgatttgatgaacctataagtctattcatctctgttatttcatttctcaaatgtgagccttgttgaggtccattatcaaatctacactttggttgattatatgatggtttaggacaaggcagaaatttaaaacctgcatgtttagtgcatca

SEQ ID NO: 24814 - DNA, 296 bp, Homo sapiens
gtatctgtttgtatttttctttgatgaatgattggtcatgaggcctcttgcccactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatgg

SEQ ID NO: 24815 - DNA, 417 bp, Homo sapiens
  misc_feature 32: n = A,T,C or G
gaattgagttcaatgttagtttgatactaatnagtccattctgtttatttttgaattactgctttcatttggaatgcatttaaaaaataaattttaaaaaatacaaatataaataaaaattatatgtctgtattcacacacacattttgtgtatgtgtgtatatgtacacaagttaattaaataaaattgtggacttttaaataaaattatagatcaaataaattgtagacaattggtggaaagaggatggcctatgtcagatcgagccacctaacatttctttcagagagtacaaacattttgaagcatgtagtatctgcacgtgttttaaaattatgcataaattaattcttcgttaaatcctactgctgggtccttaagtgtcattaatttactgattctgccattatatttat

SEQ ID NO: 24816 - DNA, 364 bp, Homo sapiens
  misc_feature 1, 10: n = A,T,C or G
nattcctganacagtttgctaatttaaaaatgtagcattccatttgtatttatttctctcccttgccaaaaagattttctaatactgcttgtaccagccagagaaagatccaaaacactactcagctctcttgcactgagggaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttttatgttgcatgttgcttttgttatcagcctgattttttgctcagtatatgatagttctg

SEQ ID NO: 24817 - DNA, 165 bp, Homo sapiens
agcaaatgtggtaaaatgttaaaagtttttttaaaaatggtacgatgggctggccgtagtggcttacatctgtaatcccggcactttgggaggctgaggtgggaaaatcacttgagcccagaagtttgagaccagcctgggcaacaaagtagaccctatctctac

SEQ ID NO: 24818 - DNA, 353 bp, Homo sapiens
ggatttctaataatctgtctttctgaaaattcttagttgcctatggtcacaggaatttgtccccatttttataggacactattaaaactggtctacttgtgttagagacatggagggaattcattttcactggatcttgtcttggttaggtatttaggtactgtttgtttggtttgttaggtttgtctttaacctatagtagatccttatatgactataaagcaagggttaggtttaaataaataaaattattcagtgtcaaatgatggagtatctttcaagttcagtgaaaatgtggaaagtacagtttaaattacagcagtgggattgggaaacaaattatatgatagtac

SEQ ID NO: 24819 - DNA, 379 bp, Homo sapiens
  misc_feature 2, 13: n = A,T,C or G
gnagaattcggcncttatggccgagattgtagaactctatgaactgaagaagatattgaaatgatctttatcacttttaattaattagaagctggggccaggagcagtggctcatgcctgtaatcccagcactttgggaggccaaggtgggtggatcacctgaggtcaggagttcaagaccagcctggccaacatggcgaaaccctgtctctactaaaaatacaaaaatgagccaggcatggtgacatgtgcctgtaattccagctactagaggggctgaggcaggaggatcacttgaacctgggagttgggaggttgcagtgagctgagatcgtgccactgcactccagcctgggtgacagagtgggactccatctcg

SEQ ID NO: 24820 - DNA, 334 bp, Homo sapiens
  misc_feature 5, 11: n = A,T,C or G
gccgncccatngtggaccgggggatggagttggattcttcatacagcaaagtagctgccatgatttcaccaagtaaatatttgaggcactgctggtcacatggtctctgccataactgctctgctgttgtaatgccaaagtagtcatagacaatccatgaatgaataagtgtggctgtgtcattatcaaactttacacctaaatttgaattgcattaaactctcacatggtcaaaagagtcttacgatatgttttccccaaccatggctcacagctcccagaaaaataggtgatggactgtgtatcagccaccatttgcagatacttttttagg

SEQ ID NO: 24821 - DNA, 461 bp, Homo sapiens
  misc_feature 25, 221, 317, 376, 382: n = A,T,C or G
catcacagggtaaagcactaagtcngaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagntttgtgttgggttttctaaaataatattcttacaaagtatttttttacctgttatgccctgtttgcaaaaacaatttagaaaaaaacaacaaagcnaaacctatcttggcaaaaaaaaggaagtgagtcagagcccattttcaggaggcattggngatgtncggctcacatattgtttgcagacacacaagaaatctggcttggccaggattggcacctagctatgaagggctgagcgag

SEQ ID NO: 24822 - DNA, 425 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgatt

SEQ ID NO: 24823 - DNA, 182 bp, Homo sapiens
aacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtg

SEQ ID NO: 24824 - DNA, 438 bp, Homo sapiens
  misc_feature 375, 437: n = A,T,C or G
ggtcaggattcttgatttattatatttgggtctagaaggtagcagtagggatcatttttgaaagttgggggatgatgtcattttggagaactcactatataagaagcacttggttgttttggacatgaaaattggggggcaggctgggcacagtggctcacgcctgtaatctcagcactttgggaggctgaggtgggcagatcacttgaggccaggagtttgagaccaacttggccaacatgatgaaacattgcctctaccaaaaatataaaaattagccaggcttggtgacacacacctgtaatccctgctactagggtgactgaggcaggacaatcacttgaacctgcgaggcggaagttgagtgagtgaaanggttgtgccacttgcactccagcctggcaacagagtgagattctgtctcaaaaaacaaaaant

SEQ ID NO: 24825 - DNA, 460 bp, Homo sapiens
  misc_feature 8: n = A,T,C or G
attatttnttttaaaattagtgtttttcatagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactggttactttgttgattctcagttactgtaggcatcaaaaggcaaaaatcaaga

SEQ ID NO: 24826 - DNA, 472 bp, Homo sapiens
ggcagataatttttagcttagggcctggtggctaggtcggttctctcctttccagtcggagacctctgctgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtgaattacagcaagctgaagaaggaacgtccggatttctaaatgaaatgtttcactataacgctgctttagaatgaaggtcttccagaagccacatccgcacagttttccacttaaccaggaaatatttctcctctaaatgcatgaaatcatgttggagatctctattgtaatctctattgggagattaca

SEQ ID NO: 24827 - DNA, 475 bp, Homo sapiens
gtggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaaagttgtcattgttgaagaagcacagagttcagaagactttaacatgggctcttcctc

SEQ ID NO: 24828 - DNA, 452 bp, Homo sapiens
gataatcattatttaaaaacatatcctgtttacctcatggggagcagggttgagaaccaattttctatgctttgagagaatcatagtagacagattagacagatgagaataaaaacagacatttagaagaggcatgtgagaaaattagcctctttgtgttaataatcctcatctgtgaaattaagataataacctcataaggttattgtgaagatttgaatgtgtgaaaacatgcaaagcacattgtgtttgcaatgtcaactattattacatcttcaccatagagtcaatcaaatagtgaacaaacattcctcggtacaatcttccatagattgtgctaggcttccctaaacactctgacactctacagtatatccagtcactcattcatttatcaggtgtgaagatcataagaggcactttttcagtcattatgtgacaatgccagaccg

SEQ ID NO: 24829 - DNA, 354 bp, Homo sapiens
ataaaagaattttgcctgccttttcagaatctcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacat

SEQ ID NO: 24830 - DNA, 325 bp, Homo sapiens
  misc_feature 1, 324: n = A,T,C or G
nataaaactttataaacaaacattttgtaaatagaatctatgctacagtaaaataattaacacaattatttacatgcaatactgacaaatttggcactttttgaaaagaaatgtacaaaacacttgctttaaaagaaatttaaaattataaaaactccgagcattactatcatgcactttgcaaatacctcacaagcacttatggcacagctatcagagagcatcaggctctctggtaatatttatgtaacttttaatgtgcttccataagtttgttgtaaaaccacctggacattgtcaagaataaagtcaaatgccatattnc

SEQ ID NO: 24831 - DNA, 444 bp, Homo sapiens
gcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatga

SEQ ID NO: 24832 - DNA, 265 bp, Homo sapiens
  misc_feature 41: n = A,T,C or G
ggtggttgtgtggtcgcgtctcggaaaccggtagcgcttgnagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggc

SEQ ID NO: 24833 - DNA, 415 bp, Homo sapiens
gtctacaactggatggtaaagttgattgaagtgtgcctcatgtagctttatgtttggggcatttgaagggctatggctggaccagagtgtaatataaatgcttaatagagaggggaaaagaagagtgtaagaaccattatagggctgggcccacgcctgtaatcccagcattttgggaggctgaggcaggcggatcacgaggtcaggagttcgagaccagcctgaccaacgtggtgaaaccccatctctactaaaaatacaaaaattagccagtcgcggtggcacgtgcctgtaatcccagctactcaggaggctgaggcagaagaatcacttggacccaggaggcagaagttgcagtgagccaagatcatgcctctgcaccccagcctaggtgatagaagtgagactccatctc

SEQ ID NO: 24834 - DNA, 121 bp, Homo sapiens
gaaggcattgtagactaatacgaatgggcagattatccaggaaatatggccgagaaaattggctcatatctgagaattcttctctggaattttaaatccaagataattgttaagcatattt

SEQ ID NO: 24835 - DNA, 293 bp, Homo sapiens
tatgtatatacacatatatatgagagaatcttcatgatcttgatgtaggagagaatttcttaaagaactaaaagtacaaatccaagaggaaaagattaataatttgactcccataaaattaagaactgctgtatattttcaaagatagcaccagctgtggcagtgaagtcatttgctatctgtaacctacaaaggtgtgagtatccagaaataggcaattcagtatgagttacggctttcaataggcacttctgagaagaggagatgatattatgatatactcacagatttgc

SEQ ID NO: 24836 - DNA, 470 bp, Homo sapiens
gggttttaagcaggatgtatcaatgcatgtcagatgggggtagataactttggggcaggttatcacaacctaagagttggtggagaaaacatgggaatgaattctagagaccacaaaatgaaaacttgaaagtgttactctttctcagcttaacgtttttaaatccaaaaaacaatttttacatttcttgggattcgaagagttgaacttcaggttgccgtggttacagtgtacagtatatatttatcagtctgtaccagtagaccagtaccctaactactgaaaagaatatggcagttttccatttgtctagtttctgtatgtacaatttactatccaattaattacttaagtggatttcttgttcttttttaaaaacttattgctacattgataggcagaatagcttctgaaagtgaccagttttcaatttcataggaagaggtgactcattgaaaaatagctcaagc

SEQ ID NO: 24837 - DNA, 472 bp, Homo sapiens
gggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggag

SEQ ID NO: 24838 - DNA, 473 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttggaaggcgatcttttaaaaagagattaaaccgaaggt

SEQ ID NO: 24839 - DNA, 306 bp, Homo sapiens
ggttgcccttggtctcggggtcgctgtaggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaaccccagtgaagaagttacctggaagtaaagactggctagattatcgaatgttcacattttaaagttctgagagaaataaaaacatgtagaatctgaaaaaaaaagga

SEQ ID NO: 24840 - DNA, 300 bp, Homo sapiens
  misc_feature 5, 16: n = A,T,C or G
agggnaattgcggccnttatggaccgggaatggctcacatctgtaatcccagtgctttgggaggctgaggtgggcagatcacttgaggtcaggagttcgagaccagcctagccaacatggtgaaaccccatctctactaaaaatacaaaaattagccaggcgaggtgatgcgtgcctgtagtcccagctacttgggaggctgaggtgagaaaatcacttgaacccaggacatggaggctacgatgagccaagatcacaccactgcaatccagcctgggtgacagagtgagaccctgtctc

SEQ ID NO: 24841 - DNA, 465 bp, Homo sapiens
  misc_feature 312: n = A,T,C or G
ggaatacagtggtgcaatcatggttcactgcagcctccctcctcccaggctcaggtgatcctcccacctcagcctcctgagtagctgggactacatagcaagccaccatgcctggctttttttttgtttgtttgtttgtttgtttgtattttttgtagagacgagattttaccatgttgctcaggctggtctcgaactcctagactcaagcaatctgcccacttagccccgaagagctgagattacaggcgtgagccactgtgccctgctagtctttaaaattctgcaataggtttagcagtgtcttagcanaaagtgctatttgagtgctggcgactggcttgcatagtggaaatatactggcctgagctctgcccacctgaccacatactgatgtcattatcctcccttcatcaaccccctctgcttcacatagtcttgtctgaagggaatgggtcagctgga

SEQ ID NO: 24842 - DNA, 471 bp, Homo sapiens
  misc_feature 461: n = A,T,C or G
gtaaatgagaattataaactctattccgttttggtatactaaatgttcttttaaccatctttaggaatatattgaaatgccaacaatagtttgaattgtgttctgtaaaaaagtattagtcaattatttttcaaaatgtagaattgtagaaaatgtcaatttttcaaactcatttttcattgctaggatttcttttaaaaaaattaaagtaatttcacttcatagcttgttgcattaacacctgtaattctattgtgaaagaaatttgattttttaattggtgtgtgttatgcccaagatgttaggatgaagatgctacctttttaaaaattttagttattggtaaaatgtttaattttacttaaaattaatttcttttcttgaaagttgtttattctgttctaaaagtagtcctgtcactgtgtttttatgctacttatagaaggggaactgattgccgntcctaggctg

SEQ ID NO: 24843 - DNA, 453 bp, Homo sapiens
  misc_feature 10, 204, 323, 324: n = A,T,C or G
tgcggccccntatggaccgggcaaagcaaatagtagaagctcaaacaacacagtaaaccaactagatttaacaggcatgtacaaaacactctacccgacaggactagtatacacatttttctcaagttcacatgggacattttctacaatagatgacatgatggactacaaattatgtctcaggaggtttttaaaagatagatntaaggcagagtattatctcggaccacaatgaaatgaaggtagaaataataacaggtaaaattagaatttgtgggaattgaacaccccaagacaaccaatgaatcaaagaaaaaattgtnngggaaactggaaaacacttagagatgaatgaaacacatcttagagaaagtgaaaacacaacacactaaaacttaatagtatgcaatgaaagcagtactgagggagaaatttatacctacaaacacttat

SEQ ID NO: 24844 - DNA, 415 bp, Homo sapiens
attcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttaagtaggcttctatattgcattt

SEQ ID NO: 24845 - DNA, 401 bp, Homo sapiens
cttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataatatttttttaaact

SEQ ID NO: 24846 - DNA, 250 bp, Homo sapiens
  misc_feature 7, 9, 56, 116, 203, 206: n = A,T,C or G
tcaggananatataatgaaaagggattattacaaaggggccttggaccttcttagngataccaacatggtttactttgctatggaatgtatacaaaaaacctttattctgatgatnttcctcatgctttgagagagaaaagaaccacagtggttgcacaactgaaacagcttcaggcagaaacagaaccaattgtgaagatgnttnggaagatccagaaactacaaggcaaatgcagtcaaccagggatg

SEQ ID NO: 24847 - DNA, 169 bp, Homo sapiens
  misc_feature 167, 169: n = A,T,C or G
taaggaaaaacttaatttgttcatccctaatttgatatatttgcaaaaaagtgttaattcactcattaaaacctaggcgtctgatgggtacagcaaaccaccatggcacgtgtatacctatgtaacaaacctccacattttgcacatgtatcccagaacttaaagtntn

SEQ ID NO: 24848 - DNA, 260 bp, Homo sapiens
  misc_feature 4, 7, 8, 122: n = A,T,C or G
ggangcnnggactgagttgtgggggagggaggcggttagcgggctttagcgccttttctggcggcggtagatttgaagcgcttcaaaggaccggacccagagaagaggaaaactctaccggngcaggacacagggatcagttgtccttgtttttttttggccttttcttcatttgaagattaagtattggagccatgggaataaaggttcaacgtcctcgatgtttttttgacattgccattaacaatcaacctgctgga

SEQ ID NO: 24849 - DNA, 312 bp, Homo sapiens
gaacgggggcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttgg

SEQ ID NO: 24850 - DNA, 468 bp, Homo sapiens
atggaactagggggagaggaaatgttagctatcctgatgacagtggtgatgaagatgactgttacaggttgaattgtgtcccttcaaaagatatcttgaagtactaacccccaaaacctcagattgtgtttttatttacaaataagctctccacagaggaaacaaaaattaaaatgaagtcattagggcgagcctggatccaaaatgactggtgtccttataaaggaaattaggacctagaggcagatatgcacagagggaagacgatgtcaaggcacacagggaggagacacccctgtgactgcagtgatgcagctacaattcagggaacataaaggatttctggcaaccaccacaagccaggaagaggcaaggaaggattctctctgagaagaaccggagagggtgtggccctgctgatatattgattttggaattctagcctcctgaattgtgagagaataaatt

SEQ ID NO: 24851 - DNA, 411 bp, Homo sapiens
  misc_feature 10, 14: n = A,T,C or G
ccttatggcngggntactataaccttcgaagcacttctttttgttatcaaaaagctaaactatgaaatccttccaatacgtgttgaatacaaagaagcctagataataaagagcccgttagactttatatgaaacctagtaaaagtataacctttggccattagaaattaagctttttcttttatatggtaaatgtatgctattaaaaacctggaaaaggacactttcatcctaactcctaagacttcattagttaaaatcctgctgtgatagaagccacagcctgtctttagaagtgggagctggtgctgtaataccttggtagaggtgggagctcacttttagtttgaagagtgtaggggttgtcaagataaaatataggatgcccagttatattttgaatttcagatc

SEQ ID NO: 24852 - DNA, 471 bp, Homo sapiens
  misc_feature 1, 71, 122, 135, 195, 240, 260, 356: n = A,T,C or G
ngatcactaacagaaaggaaatgatggaggaaagagtcagtattcttgaggctggattaatagaaactgtntactcgaacacagggtaaaattttaaatactgttatgaacaagaaaggttntaacaaataatgngataatgataaaatctgagcttcagaagggaagaacaatgaggatgctattgagagaganctcaaagacataatggctgaaaattctccaaacttgcaatgggcntaaacctacagatgcaagangatgagcaacttgccaaccagaatatacccaagaaaatccatgcaagcaacactgtagtcaaatttctaaaaactaaaaaaaatgttttgaaagcngcaagaaacaaatgacaccatagctatggggaaaacacaatgtgagtaacaggtggtgttattaccaggagagcagaataaccaataggatgtagctaaaatattcaaagtgctg

SEQ ID NO: 24853 - DNA, 482 bp, Homo sapiens
  misc_feature 333: n = A,T,C or G
gtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccanggccgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgag

SEQ ID NO: 24854 - DNA, 422 bp, Homo sapiens
  misc_feature 176, 182, 183: n = A,T,C or G
gatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatgnacccannaataggatttgctataatgggattcattggcttctttgtgaaattgatccatattcctattaataacatcattgttggtggctgaatacattttggaagagagtttttcatcttagagattggtggacaagtgtgagggtgtgagaaactcacagaatacaaatttgcctgtatgttttgtgggtttttttttttcctttcaagatgttttctatttctaaattaaaggaatttcaaag

SEQ ID NO: 24855 - DNA, 347 bp, Homo sapiens
gcctttccggcggtgacgacctacgcacacgagaaacatgcctctcgaaaggttctccttcatccctctccagaagaggagaagaggaaacacaagaagaaacgcctggtgcaagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccattctcaataagcacattttggat

SEQ ID NO: 24856 - DNA, 471 bp, Homo sapiens
ctattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagcca

SEQ ID NO: 24857 - DNA, 478 bp, Homo sapiens
  misc_feature 41: n = A,T,C or G
gatcccataggagcctctctccctactgctgctacacaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgcccgaggggccaaatgagactgagggaagaaaaaaaatctctttttttctggaggctggcacctgattttgtatccccctgtagcagcattactgaaatacataggcttata

SEQ ID NO: 24858 - DNA, 391 bp, Homo sapiens
  misc_feature 4, 5: n = A,T,C or G
gcannctggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgc

SEQ ID NO: 24859 - DNA, 487 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaagtaatttgaaggcgatcttttaaaaagagattaaaccgaaggtgattaaaagaccttga

SEQ ID NO: 24860 - DNA, 345 bp, Homo sapiens
  misc_feature 110: n = A,T,C or G
tggaagaagatgatggaaatcatgacccgaggggggcagacaaatgacttgaaagaagtggtcaataaattgattccagacagcattggaaaagacatagaaaaggcttnccaatctatttatcctctccatgatgtcttcgttagaaaagtaaaaatgctgaagaagcccaagtttgaattgggaaagctcatggagcttcatggtgaaggcagtagttctggaaaagccactggggacgggacaggtgctaaagttgaacgagctgatggatatgaaccaccagtccaagaatctgtttaaagttcagacttcaaatagtggcaaataaaaagtgctatttgt

SEQ ID NO: 24861 - DNA, 436 bp, Homo sapiens
gctcatgaaaactgtacttcataaatattttttcttgaattttaaaactttacagtaaatttaggacccgaagacaccaaatatagacactgcttggggaggaagcctagtatgatgaggttaactgtgggcaatttcatttcctaccctaggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatggtaaggtttggggatgtggccttactactatggtgccaagct

SEQ ID NO: 24862 - DNA, 273 bp, Homo sapiens
ggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccg

SEQ ID NO: 24863 - DNA, 499 bp, Homo sapiens
  misc_feature 2: n = A,T,C or G
cnggccgggagttctgataatgttaagaataaccattatgaaaaggaaaatttgtcctgtatagcatcattatttttagcctttcctgttaataaagctttactattctgtcctgggcttatattacacatataactgttatttaaatacttaaccactaattttgaaaattaccagtgtgatacataggaatcattattcagaatgtagtctggtctttaggaagtattaataagaaaatttgcacataacttagttgattcagaaaggacttgtatgctgtttttctcccaaatgaagactctttttgacactaaacactttttaaaaagcttatctttgccttctccaaacaagaagcaatagtctccaagtcaatataaattctacagaaaatagtgttctttttctccagaaaaatgcttgtgagaatcattaaaacatgtgacaatttagagattctttgttttatttcactgattaatatactgtggcaaat

SEQ ID NO: 24864 - DNA, 101 bp, Homo sapiens
  misc_feature 28, 68, 82, 84: n = A,T,C or G
ggaggcattgaggcagccagcgcagggncttctgctgagggggcaggccggagcttgaggaaaccgcngataggtttttttntntttgaaagatagagatt

SEQ ID NO: 24865 - DNA, 469 bp, Homo sapiens
  misc_feature 127, 229: n = A,T,C or G
gaaggtagaagaagatcatgaatcaccatcttcaggcagggtaccagcaccagaacacctccattgaagaaactgaatcagatgccagtagtgatagtgaggatgtatctgcagttgttgcacaagncctccttgacccaacagagacttttggtttctaatgcaaaccagacagtacccgatcgatcagatcgatcgggaactgatcgatcagtagcagggggtgganagtgagtgtcagtgtcagatctagagggcctgatggacagtgcacagtaactgaagtttaaataaaaatgtcttcagctccgtgctcaaggttgaaagggtaccctgtaaatttctgcccccataacattatactcatccctagtagtgcattttgggagttggggtgggaagggggtattgggaaggatagactcattaattaaaatgtctaacatgtctctgttgagaaatttattta

SEQ ID NO: 24866 - DNA, 268 bp, Homo sapiens
  misc_feature 178, 257: n = A,T,C or G
aatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcangtaagataaactatttaggaaaaaagtctgatgaatttaatgcctgtgggaaattgttactcaatattaagcatgatgnaaaacttcatt

SEQ ID NO: 24867 - DNA, 242 bp, Homo sapiens
taagtctaataataataactgataagtccattgaatttgcttctgattactttttctttagtagctaaacatgtatgtactcctatgattacaatgaacactcctctccatttaaattaattatttacatcgatgaaatagcaaaatgttaatgactaaatactgtcttggttttttcgttccaggtcagtcaatattaacttcttataattttcttttttttctttatgtgtgtgtgtgtg

SEQ ID NO: 24868 - DNA, 489 bp, Homo sapiens
  misc_feature 1, 31, 216, 468, 480: n = A,T,C or G
naggagtggcagaagatcccttcactcaganaagcaaggcttgatattagcttgttgaatgtaagagacacaaatgaagaagaacaaagagcctgagaaagcagcaagaggacatgatgaaaaatacgtggagttgatgagaaaggggagccaaggctttatacgtctaaagaaaatattcagtagctgaatccgcccagtgatagcctgtgggcnccagcagcaagggctgccatgggatacagcacccatctacaaagacctctattacataaacactgcttcttacaggaaacaaacctcttctgggatctccttttgtgaaaaccagtttgatgtgctaaaagtaaaaagtctattttccagggtggccttgttcagaagcagccagatttccaatggttgttttttccccttccactcagaaaccccctgcccttttccctttcagaaaacgatggcaggcanttcctcttgagnttacaagca

SEQ ID NO: 24869 - DNA, 468 bp, Homo sapiens
  misc_feature 225, 461: n = A,T,C or G
gaactcggtggtggccctgcgcagacagacttcgctcgtactcgtgcgcctcgtttcgtttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgcnaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgccttttcccatctgtctatctatctggctggcagggaaggaaagaacttgcatgttgggtgaaaggaaagaagtggggggggaanaaagtgg

SEQ ID NO: 24870 - DNA, 241 bp, Homo sapiens
  misc_feature 19, 21, 59, 239, 240: n = A,T,C or G
gaagaagaataagccaagnanaaagaggttaagctggctgtcctgaaatattataaggnggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaccnna

SEQ ID NO: 24871 - DNA, 472 bp, Homo sapiens
  misc_feature 3, 5, 135, 349, 424, 451: n = A,T,C or G
cgncntttatggcggggaagaaatgacatctttgaatcgctgtactacaggaaagaatgtacggagacatggcatgaagccggagagtgagagacattaactcattagactggaacttgaactgattcacatctnatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggactacattagtacacagcaccagaatgtatattaaggtgtggctttaggagcagngggagggtaccagcagaaagggtagtatcatcagatagcatcttatacgagtaaatatgcctgctattttgaagngtaatttgagaaggaaaattttagcgngctcactgacctgcctgtagc

SEQ ID NO: 24872 - DNA, 336 bp, Homo sapiens
  misc_feature 10, 14, 31: n = A,T,C or G
cccctctatngacngggattacccccaaagnatttgtgaagtttattcgaaaaaatctcctgtttctctggatgatagtgacattgaagctcgccttaatagttggaatcttgggatagaaaatcctcgatacctgagacagaagcctatcccagtttctctgcagatgacaccgaaattcagcctgagaaaatccagcagtttccatgatgatcattttctctctcgaatacgtgagaaagagctggacatgaaaacaaaaatgatggaagctaaatttcatgaagaaaagcttaaactgcaacagaaacatgatgctgatgttcagaagatttt

SEQ ID NO: 24873 - DNA, 403 bp, Homo sapiens
  misc_feature 12, 18, 296, 320, 349, 374: n = A,T,C or G
aaaatactgagnacttcncctcatgattgtgaatggagatgtaccagttcattttcttacctaaatctgggtgagtcttttaagagttactcattgaattaatctttattaataagataatttttgtaatttgttaaaaacaaaagattagtcatggatatttctatcttttcagatacaacagagtggaccaccctagtatcagattctcaggaagataaaaaaaattcaagaccaagaccaagagctggccactgtgctgttgcaatcggcactcgattggtatttttgggggnggaaagagatggctacaaaaagcnctgaatagtcaggttgctgcaggatcttnggatctggaaccgggaggaaagaanttttaaccaaaaaactttttcctttagga

SEQ ID NO: 24874 - DNA, 235 bp, Homo sapiens
  misc_feature 11, 235: n = A,T,C or G
aactaacaagncgaaacaaccagctaacatcataatgacaggatcaaattcacacataacaatattaaccttaaatgtaaatgggctaaatgctccaattaaaagacacagactggcaaactggataaagaggcaagacccatcagtgtgctgtattcaggagacccatctcatgtgcagagacacacataggctcaaaataaagggatggatgaagatctaccaagcaaatggn

SEQ ID NO: 24875 - DNA, 498 bp, Homo sapiens
  misc_feature 11, 15, 115, 135, 136, 206: n = A,T,C or G
caggcggggtnttcngcctttatgggcggggggctaacgatggatgtgaagaacctcttcaaggggaactacaagccactgctcaaggaaataagagaggacacaaacaaatggnaagcagaaaaaagcaggggnngaatcttagtttctgacaaaacagactttgaatcaacaaagataaaaaaagacaaagaagaacatcacantgataaaggaatcaattcaacaagaagagctaactatcctaaatatgtatgcacccaatacaggagaacccagattcacaaaacaagttcttagagacctacaaagagactcaggctaccacacaacaatagtgggagacattaacaccccattgccaatattggatcatctaggcagaaaattgacaagaaaggacttgaacacagctctggatcaagtgaatctcatagatatctacagaactctccaacacgaaacaacagactatatattattcttagtggcatatga

SEQ ID NO: 24876 - DNA, 103 bp, Homo sapiens
  misc_feature 11, 19, 25, 38: n = A,T,C or G
aaattcggccnttatggcncggganttctacaaaatgnaaaaattagctgggcatggtggtgcactgcctgtagtcccagctacttgggaggctggggcagga

SEQ ID NO: 24877 - DNA, 389 bp, Homo sapiens
  misc_feature 6, 148, 187, 197, 227, 261, 289, 333, 334, 389: n = A,T,C or G
cggccnttatggcggggggtgaaaaaaaaggtcttggtgaggtgccgccatttcatctgtcctcattctctgcgcctctcgaggagtttcagcagcggtatgttgggccagagcatccggaggtcacaacctctgtggtccgtaggancccttttgaggagggcctggaagaattgccattttcagnggaaacaagnggccgtactagctaagatgggttgactttngatctgcattgctccccccttcttgagtaagacnccactgcttaaacataaggtgttcagtnctcatttacagattgaagagcttttaagagggcagcctttggannggtcaaactagaactcatatgcctactagatttgttggcaataaacttatgacgn

SEQ ID NO: 24878 - DNA, 102 bp, Homo sapiens
  misc_feature 27, 28, 52, 74, 83, 91: n = A,T,C or G
ccgggtattcggcctttatgggggggnngatttaagaagctcctctgccagnaccaaaaggaaaagaagaaaangggccaaangccaaaangaaactgaggg

SEQ ID NO: 24879 - DNA, 282 bp, Homo sapiens
  misc_feature 4, 5: n = A,T,C or G
aggnnctagtatatcctccaagaaatataccacaagtttttccatttgactttgagctgctgttgaagtggtgagtgctgtgttttgagcttattttgaacctagatccttgtgaaaggtacaaatagaggtaatagttaagttatggcatttattaagaagttttattatttggcttcctttagaattattgtgaagtttaaaaatagcctttctcctgcaaattttcctagtctttagtaactgttagtgttctatatagcacaaacttgaatctctcag

SEQ ID NO: 24880 - DNA, 467 bp, Homo sapiens
  misc_feature 145: n = A,T,C or G
aatgttgggacacctaaatatacaaagcaatattaacagaatggaagagagaaatagacagcaatacaatagtattaggggactttaataacccccatggaaaaatgtatagatcatccagaaaaaaaatcaataaggaaacagngggaggaataacactgtgggccaaatgaacctaacagacaaatacagaacatgctatccaacagcaaaagaatacaaattattgtcaagtgcaaagagaatattctcctgtttagatcatatgttgagccacaaaataagtcttaacaaatttaagaagattgaaatcatatcaaatatattttctaaccacaatggtataaaaagacaaatcaataagagaaaaactggaaattttacaactgtgtggaaattaaacaacacacacctaaacaatatgtcaaagaagaagtcaaaaatgacatttaaaaatatcctgagac

SEQ ID NO: 24881 - DNA, 475 bp, Homo sapiens
  misc_feature 429: n = A,T,C or G
ggaggtacagaagcagctgtattggttacaggcttatttgccttatttgaacagaggttgaatagttggccacctttgattggctgaaactcagtgattggcacatgagtaggttccagtctgtttacacacccattcagtctacagtttactatgtgaaagtttatgaaaaaacctttagaataggtaaagagacacctttaggctaaacttaatttaacaaatgctactgactgattaagtaagaagactcaagagtgtcctttgggttgttagcatggaggtcgttggcaaccttaaagagacatttcagtggagtgccaggcagggtggtgacacctggatcacacagatatgaatgactagagactatgcttttgagaagttttgatgtgaaggggagcaagaaatggactggtggccaaggcncctgaggagtcaagggagtgttttctttttcggatgaatgaatctg

SEQ ID NO: 24882 - DNA, 361 bp, Homo sapiens
  misc_feature 1, 9: n = A,T,C or G
nattcggcnttatggcggggatttcacatttgatatgtagagaggaataggggttagtttatgtttatattgaaaaactttaaagactatttggaagttccagaaattctggttttaattcaagtaaaatgataaaatagtcattatatagttcaggatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactg

SEQ ID NO: 24883 - DNA, 191 bp, Homo sapiens
gtagaaaatggagacatggcgaaccgtctctacagaaaatacaaatattaaccaggcatggtgtcatacgcctgtactcacagctactcaggaggctgaggtaggatcatctgaacccgggaggcagtttgaggtgagccatgatcatgccactgccctccagcctgggtgacagagcaagaccctgtctc

SEQ ID NO: 24884 - DNA, 496 bp, Homo sapiens
  misc_feature 19, 20, 40, 127, 202, 344, 483: n = A,T,C or G
gggagccggggaattcggnntttatggcgggggtatcttnctttgaattagattttcattgcaccttacctcaattctgttgcacatttatttaaagatctgataaactgagaaaagtatacttttngaggatacatttcaaccatttttttctgagttcatatatatcagggcattagggcagctcagaaaatcacaagtnggaaacatagtcttaacaaatttgttatttaaaggaaagagaaatagcataaaattaagatcaaatttatcaccacagtatgtctactttcactggtatcagagtctctggggcagaaattatgtctgtgtctcttgcttgngtgcttttttcctccctatctcttgaaattcaaactttgaatatagtaaaattctggaaagctatataagaatatggcttatattcttatatatataccttatatacttaaggaataagtaatcttaaataatcagagntatggacaaagat

SEQ ID NO: 24885 - DNA, 101 bp, Homo sapiens
  misc_feature 9, 17, 30: n = A,T,C or G
aacccgggnattcggcnttatggcgggcantttgggaggccaaggttggtggatcacctgaggtcaggaagttcgagaccagcctggccaacatggggaac

SEQ ID NO: 24886 - DNA, 150 bp, Homo sapiens
gtggagccttctctctttttcccaaggagtccccagctgtcagaaaagtaccttaggtcctctcatgtgggcattcagagtggcaggaagacagactggggaaataattcagttgactgagaagaaagacaaacaaaaactcattcctcg

SEQ ID NO: 24887 - DNA, 473 bp, Homo sapiens
  misc_feature 165: n = A,T,C or G
gggtggctggacaaaggatgacgatgttcctttgatgtggcgtatgaagcagcatgctgagtgttggaggaaggagttctgaatcctgagacgacagtggtggccatcttcccatctcccatgatgtatgctggaccaactgaggtccagtggcattgcagagcncggatggttgcaggagccaactttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacaccatgaagactttgaatttatttcaggaacacgaatgcgcaaacttgctcgagaaggccagaaaccacctgaaggtttcatggctcccaaggcttgga

SEQ ID NO: 24888 - DNA, 142 bp, Homo sapiens
  misc_feature 2, 22, 48, 53, 65, 77, 133: n = A,T,C or G
tntagcccgctaccctgaggtnatagaacactcccagggaaacagcangacanggcctgaaagtntctgcagtgtanccccttccactcatgacaagacattaggacccggagcggaggagaagacggaggtncatgagaga

SEQ ID NO: 24889 - DNA, 491 bp, Homo sapiens
aactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcagaacagtctttgaatatcgaacacgcaaggctgtgagactacctattgtagatattgcaccctatgacattggtggtcctgatcaagaatttggtgtggacgtt

SEQ ID NO: 24890 - DNA, 301 bp, Homo sapiens
  misc_feature 103, 106, 109, 274: n = A,T,C or G
gaggcattgaggcagccagcgcaggggcttctgctgagggggcaggcggagcttgaggaaaccgcagataagtttttttctctttgaaagatagagattaatncanctncttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagtaaaaaatgtatct

SEQ ID NO: 24891 - DNA, 190 bp, Homo sapiens
  misc_feature 5, 7, 188: n = A,T,C or G
gaaancncaggggaattcggccattatggaccgggcggtggatcactcggctcgtgcgtcgatgaagaaacgcagcctagctgcgagaaattaatgtgaattgcagggacacattgatcatcgacacttcgaacgcacttgcggccccgggttcctcccggggctacccctgtctgagcgtcgcttgnga

SEQ ID NO: 24892 - DNA, 328 bp, Homo sapiens
  misc_feature 7, 11, 71: n = A,T,C or G
gttatgncagngaggaaggaaagattatgtcttcccctctttccaaagaagctgagacagaagtacaacgngcgatccatgcccatccgaaaggttgatgaagttcaggttgtacgtggacactataaaggtcagcaaattggcaaagtagtccaggtttacagggaagaaatatgttatctacattgaacgggtgcagcggggaaaaggctaatggcacaactgtccacgtaggcattcaccccagcaaggtggttatcactaggctaaaactggacaaagaccgcaaaaagatcctcgaacggaaagccaaatctcgccaagtagt

SEQ ID NO: 24893 - DNA, 454 bp, Homo sapiens
  misc_feature 17: n = A,T,C or G
agaatagagaacccagnaaacaaatcctcacatctacggtgaactcatttttgacaaaggtgccaagaacatacactggggaaaagagagtcacttcaatagatggtgctgggaaaactggacatccatatgcagaagaatgaaacttgacccctatctcttgccatatacaaaaaccatttcacaatgaagacttaaatctaatacctcaaactatgaaatgactacaagaaaacactgtagaaactctccaggacattgatctgggcaaaaatttgttgagaaatatcccaaaagcacatgcaacccagaacttaaagtataataataaaaaagaaatggcaataccaattttactcaaactattctgataaatagaggaggaacgaatagttccaaaatcattctacaaggccaatattacccctggtgccaaaatcacactagaatacat

SEQ ID NO: 24894 - DNA, 332 bp, Homo sapiens
  misc_feature 38, 44, 60, 61, 65, 67, 70: n = A,T,C or G
gaagcaacttaagtaattgtagccttgactccttgagnactgtngatttcgatccagganncgtntntanagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacat

SEQ ID NO: 24895 - DNA, 269 bp, Homo sapiens
  misc_feature 24: n = A,T,C or G
atgattccctggattatgcaaagnaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttt

SEQ ID NO: 24896 - DNA, 500 bp, Homo sapiens
  misc_feature 12, 22, 27, 28, 31, 141, 312: n = A,T,C or G
cccacgaaggtngtccgtccgnccccnnttngaccggggaggcattgaggcagccagcgcaggggcttctgctgagggggcaggcggagcttgaggaaaccgcagataagtttttttctctttgaaagatagagattaatncaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagtaaaaaatgtatttaaaagaaaattgagagaaaggactacagagccccgaattaataccaatagaagggcaatgcttttagattaaaatgaaggtgacttaaacagcttaaagtttagtttaaaaagttgtaggtgattaaaataattttgaaggcgatcttttaaaaagagatt

SEQ ID NO: 24897 - DNA, 194 bp, Homo sapiens
  misc_feature 2: n = A,T,C or G
tngcccgggggaaaatatcttgcttgagcctgaatcgattgtagagagccagggtaaagaatggcagaaagggagaggcaaaagcaagggagaaaaagcaaggaaaaaacagagcaagggagtgatttggctagggcagacaaaagatttcagagaagggataattaagatgagttacatatgatactattact

SEQ ID NO: 24898 - DNA, 182 bp, Homo sapiens
gtttgaaacagcaacgcttcggtcagggtatcttttaccagacactaaagcatatggagatagaatagaaagaatgcttcgcctcagtttgaacattgaccctgatgcaaaggtggaagaagagcctgaagaagaacctgaagagacagcagaagacacaacagaagacacagagcaagacg

SEQ ID NO: 24899 - DNA, 408 bp, Homo sapiens
  misc_feature 34: n = A,T,C or G
gatatgtgaaaactgcagtaaaaataaacccagnatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttacca

SEQ ID NO: 24900 - DNA, 251 bp, Homo sapiens
  misc_feature 2, 6, 247: n = A,T,C or G
gnggancggggcatcagcacagcaaaggaaaaaaatcagtaaaatgaagagacaacccatagattgggaaaaaaaaattacatataacccatctcatgaggagttaatatctaaaatatataagagactcaaattactcaataacaagaaagcaaataaccctatttaaaaataaacaaagtacatgaatagacagttctcaagaaaagacatacaaatggcaaatagatatataaaaaatgcttangtcc

SEQ ID NO: 24901 - DNA, 125 bp, Homo sapiens
  misc_feature 125: n = A,T,C or G
taatataggctttaaattgctttagttgtattccattaatttttatatgtgcgcgatgactatctaggccagtggcttgagggaaacagaatttaccaagacagttgtaggcaggtgaaaggccn

SEQ ID NO: 24902 - DNA, 420 bp, Homo sapiens
  misc_feature 5, 6, 25, 28, 39: n = A,T,C or G
agagnnggagagctaaagtccaagnagnaggatccgagnaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttc

SEQ ID NO: 24903 - DNA, 473 bp, Homo sapiens
  misc_feature 2, 4, 39: n = A,T,C or G
gnangacacggggtaactcggtggtggccactgcgcagnaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtgggaag

SEQ ID NO: 24904 - DNA, 178 bp, Homo sapiens
  misc_feature 131: n = A,T,C or G
acaaatgctacattaatgtttgggtggtcagattctactttgaatctgaagtttgcagatatgcctatagatttttggagtttaccactttcttattctgtatcattaatgtaatattttaaattactatntatgttaccatttttctggatttagtaagaaatttgcagttttggtt

SEQ ID NO: 24905 - DNA, 480 bp, Homo sapiens
  misc_feature 2, 45, 64, 75, 269: n = A,T,C or G
angccgggaaaggtttggtcctggccttataattaattagaggtnaattacacatgcgaacctncatagaccggngtaaaatcccttaaacatttacttaaaatttaaggagagggtctcaagcacattaaaatagcttaagacaccttgcctagccacacccccacgggactcagcagtgataaatattaagcaataaacgaaagtttgactaagttatacctcttagggttggtaaatttcgtgccagccaccgcggtcatacgatnaacccaaactaattatcttcggcgtaaaacgtgtcaactataaataaataaatagaattaaaatccaacttatatgtgaaaattcattgttaggacctaaactcaataacgaaagtaattctagtcatttataatacacgacagctaagacccaaactgggattagataccccactatgcttagccataaacctaaataattaaatttaac

SEQ ID NO: 24906 - DNA, 111 bp, Homo sapiens
  misc_feature 3, 11, 28, 29, 85: n = A,T,C or G
ggnaggccgangtgggtggctcatgagnncaagaaatcgataccatcctggctaacatggtgaaaccccgtctccactaaaaatncagaaattagttgggcatggtgacac

SEQ ID NO: 24907 - DNA, 216 bp, Homo sapiens
  misc_feature 20, 38, 42, 55, 109: n = A,T,C or G
gtggccgggaacaaagcatnatatttcgcccactaagncaanccctttattgacncctagccgcagacctgctcattctaacctgaatcggaggacaaccagtaagctncccttttaccatcattggacaagtagcatccgtactatacttcacaacaatcctaatcctaataccaactatctccctaattgaaaacaaaatactcaaatgggcct

SEQ ID NO: 24908 - DNA, 462 bp, Homo sapiens
  misc_feature 224, 398: n = A,T,C or G
gattcaattatgttcagtatacttggttttgaaagctgatggactgtctaatacattttttaaagattttgagaaatgattcaaatttaaatggttttggaattgaagaactgtaaacttcgctcatgtaaaaaattaagctcattttttcatcatggcagatgattaagttttctaggttgcagcctttagtgttaaaactacatagtctggccgggtgcggnggctcacgcctgtaattccagcactttgggaggccgaggtgggcagatcacgaggtcaggagattgagaccaccctggccaacatggtgaaatcccgtctctactaaaaatacaaaaattagcttggtgtggtggcacgcgcctgcaatcccagctactcgggaggctgtgganggagaattgcttgaacccggaaggtggagattgcagtgagccgagatcataccactgcactcca

SEQ ID NO: 24909 - DNA, 143 bp, Homo sapiens
  misc_feature 15, 16, 20, 28, 29, 57, 60, 63, 82, 99, 107, 130, 132: n = A,T,C or G
aagaaaaaacctttnnaaanattcctgnnccctaatttgcacgaagattttctaccncangangtgccttgccttccgagantaagtattacctttaancaatatcngcgcacacacatagctgcatgtncngctcgtgtagt

SEQ ID NO: 24910 - DNA, 100 bp, Homo sapiens
  misc_feature 12, 85, 91, 99: n = A,T,C or G
attgtggctggnatggaacaacataccttggggacccctggctggcacaccttgcctctgaatttctgggcttggtcttccaggnggcatntgcctgang

SEQ ID NO: 24911 - DNA, 148 bp, Homo sapiens
  misc_feature 2, 5: n = A,T,C or G
tnttngccgggggtggtgcttgcctatagtcccagctactcgggaggctgaggcaggagaatcacttgaactggggaggcggagattgcagtgagctgagattgcgccattgcactctagcttgagtgacagagcaagagtctgtctc

SEQ ID NO: 24912 - DNA, 500 bp, Homo sapiens
  misc_feature 2, 7, 450: n = A,T,C or G
cngaaantttgctttctgaacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcanaaagtggtggctgggtgtggctaatgccctggcccacaagtatcactaag

SEQ ID NO: 24913 - DNA, 460 bp, Homo sapiens
  misc_feature 2, 13, 27, 61: n = A,T,C or G
gncataatagagnatagaaagcacagnaaggagcgtggatcggaagagaagggatacttcnggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtggaggttccaaaatatgt

SEQ ID NO: 24914 - DNA, 359 bp, Homo sapiens
  misc_feature 1: n = A,T,C or G
ntatgtagaaagctgaaactggatcccttccttacaccttatacaaaaattaattcaagatggattaaagacttacatgttagacctaaaaccatgaaaaccctagaagaaaacctaggcataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatcggacaaagggctaatatccagaatctacaatgaactccaacaaatttacaac

SEQ ID NO: 24915 - DNA, 465 bp, Homo sapiens
  misc_feature 3, 129, 297: n = A,T,C or G
ctnaagaaaagccctcatttttataacctggcaaaatcttgttaatgtccttgctaaaaaataaataaaagctagatactggaaacctaactgcaatgtgaatgttttacccacatgacttattatgcntaaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagnaaagcttttcttttttaatttccaggaaaaaataaaaagagtatgagtcttctgtaattcattgagcagttagctcattttgagataaagtcaaatgccaaacactagctctgtattaatccccatcattactggtaaagcctcatttgaatgtgtgaattcaataca

SEQ ID NO: 24916 - DNA, 382 bp, Homo sapiens
agagaattggtaaacaaaatgcattatatacatacaatgcaatatcatttagccttaaaaacaaaattctgccatatgctacaacatggacgttatgctaagtgaaataaaccagttccgaaaggacaaatacacccatttccacttatatggggtatctaacgtcaaactcagaagaacaaagtactgcggtatttgccacaagctggtggaggagaaaatgagttgttcaatgggtattgagtgtcagccacgcaagatggaaaagctttttgagatttgttgtataaaaatatgcctatagttaacaatactcttcggtacacacaaagtatgtgaaagggtaaattttatgtgtttttatcacaataaaaattgtagt

SEQ ID NO: 24917 - DNA, 157 bp, Homo sapiens
ggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaccc

SEQ ID NO: 24918 - DNA, 254 bp, Homo sapiens
  misc_feature 107, 110, 125, 179, 220: n = A,T,C or G
ggaggcattgaggcagccagcgcaggggcttctgctgagggggcaggcggagcttgaggaaaccgcagataagtttttttctctttgaaagatagagattaatccanctncttaaaaaatatagncaataggttactaagatattgcttagcgttaagtttttaacgtaattttaatancttaagattttaagagaaaatatgaagacttagaagagtancatgaggaaggaaaagataaaaggtttctaaaac

SEQ ID NO: 24919 - DNA, 156 bp, Homo sapiens
  misc_feature 20, 26, 33: n = A,T,C or G
atcaaatgaatgaacaaagnactagnagacagnagttgcctggccttattctttaaatacccacactataggactgcaacaaaatacagagccctagtgattagaagacttcaaaagtgtgttttctttttccaggtgcatgcctttgatttcttg

SEQ ID NO: 24920 - DNA, 500 bp, Homo sapiens
  misc_feature 3, 7, 489: n = A,T,C or G
cangggnatcaatggacagtccgtggtctccgccaatgatgtcagcgacgtcattaaaagggaaagcaccctgaacatggtggtccgcaggggtaatgaagatatcatgatcacagtgattcccgaagaaattgacccatagacagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagnaagaagcccca

SEQ ID NO: 24921 - DNA, 327 bp, Homo sapiens
  misc_feature 9: n = A,T,C or G
agaacgggnataggtttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccgcacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccct

SEQ ID NO: 24922 - DNA, 284 bp, Homo sapiens
gcttttacctcgttgcactgttgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttg

SEQ ID NO: 24923 - DNA, 470 bp, Homo sapiens
gataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggggggtgattattttttatactgtatgtgccaaagctttactactgtggaaagac

SEQ ID NO: 24924 - DNA, 476 bp, Homo sapiens
  misc_feature 5, 26, 30: n = A,T,C or G
ctatngaccgggaacagggcagcagnaagnaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcacttgaagagccaccctgtggaaacactacatctgcaatatcttaatcctactcagtgaagttcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgc

SEQ ID NO: 24925 - DNA, 494 bp, Homo sapiens
  misc_feature 5, 13: n = A,T,C or G
acagnaggaaagncatcacttagtgctcttacccagctgatgaaaaagatgccccatttccgaaaacagattactaagcaagttgtccatcttaacttagcagaagattgcatgaataagttcaagcttaatatagaaaagctctgcaaaactgaacaggacctcgcacttggaactgatgcagaaggacagaaggtgaaagattccatgcgagtactccttccagttctactcaacaaaaatcatgataattgtgataaaataagagcaattctactttatatcttcagtattaatggaactacggaagaaaatttggacaggttgatccagaatgtaaagatagaaaatgagagtgacatgattcgtaactggagttacctttggtgttcccattgttccccaatctcaacaaggcaaaccgttaagaaaggatcggtctgcagaagaaacttttcagctctctcggtggacaccttttatcaaagatatta

SEQ ID NO: 24926 - DNA, 269 bp, Homo sapiens
tgtagaagttatgtgtaatttttaaaaacatttcttgtcataggttctattagtaaaaatatatacagatatatatgcaaagtcttaggagatattttccatgcgaattaaacttttaactgctttaattgttttttcaaatagagaacagcatagaaaatatgacattttctgtgtgccctgttcagtttagtttacattaattaccacataaaattccaagatctatgatcaaagtttaataactgacaagttactagtaatttagt

SEQ ID NO: 24927 - DNA, 301 bp, Homo sapiens
  misc_feature 5, 7: n = A,T,C or G
tccangnaccggggaggcattgaggccgccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagt

SEQ ID NO: 24928 - DNA, 498 bp, Homo sapiens
  misc_feature 1, 3, 38: n = A,T,C or G
ngncttatggaccggggaagctttattatattttccgnatgtgattggaaaataatcttttctaatttgtgataaaaattaaatatatagatttagttatacacagttaatgaattaccttactgaagaaagtgaaattatttgaaattatagcttttgagaaagtattaattctacatcatacaaaaggctggtatttggtataacttataaaacaggtatctaggccaggcgcggtggctcatgcctgtaatcccagcactttgggaggctgaggcgggcggatcacgaggtcaggagttcgagaccagcctgtccaacatggtgaaaccccatctctactaaaaatacaaaaagttagacaggcgtggtggtgtgtgcctgtaaccccagctactcaggaggctgaagcaggagaattgcttttacccaggaggcggaaattacaatgagctgagatcacgccattgcactctctctggcctgggtaacagagcg

SEQ ID NO: 24929 - DNA, 429 bp, Homo sapiens
  misc_feature 14, 20, 22, 28: n = A,T,C or G
gggaaacttgaagnaacagnanaccagnaaagagtaaaaccttttatgacaggggctgcagaacaaatcaagtacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaact

SEQ ID NO: 24930 - DNA, 334 bp, Homo sapiens
  misc_feature 3, 35: n = A,T,C or G
aanagggccggggggatttgggaaggctttaaagnacgcatgttatggtgctaatgtactttcacttttaaactctagatcagaattgttgacttgcattcagaacataaatgcacaaaatctgtacatgtctcccatcagaaagattcattggcatgccacgggattctcctccttcatcctgtaaaggtcaacaataaaaaccaaattatggggctgcttttgtcacactagcatagagaatgtgttgaaatttaaccttgtaagcttgtatgtggttgttgatcttttttttccttacagacacccataataaaatatcatattaaaattc

SEQ ID NO: 24931 - DNA, 500 bp, Homo sapiens
  misc_feature 5, 10, 31, 32, 39, 40, 53, 299: n = A,T,C or G
cgccntatgnccgaggtccctctccatgtannaggaatnngagcccactgagngtaccagtgcattaatttgggcaaggaaagtgtcataatttgatactgtatctattttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagancaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgt

SEQ ID NO: 24932 - DNA, 471 bp, Homo sapiens
  misc_feature 139, 278, 449, 453: n = A,T,C or G
gggtttcaccatgttggccaggctggtctcaaactcctgacctcaggtgatccaccctcctcggcctcccatagtggctgggattacaggcgtgagccactgcacccagcctctatttaaaattctttatttctgtttncctaatttgattaatacagctgtaaaaatagcaaacgtgtatctaaagtgttatttcagtggcaaaggaatgtttttattttgtcgaatttatatgtgatttttaagtgaaatatttgtgtggatcttggggttttggnagcgtataaagccaataaaatcagagacttagggctacagaagggaaaaaatcctcaacatcacattcagcaatggtttagattcatgaacaagttgatagtcaaatcctgagtataaaatactttgcattctatcaacttctcaaattactagtaagaacttcatatttngggngattctctcattgactgt

SEQ ID NO: 24933 - DNA, 227 bp, Homo sapiens
  misc_feature 4: n = A,T,C or G
gganatattcattgaataaacaattaccatagttttgaatgagggagagcatgtgaaagaaaatatttgcctatgtggggtggggggaggggagagggatagcattgggagatatacctaacgctagatgacgagttagtgggtgcagtgcaccagcatgccacatgtatacatatgtaactaacctgcacaatgtgcacattgtaccctaaaattaaagtataatc

SEQ ID NO: 24934 - DNA, 319 bp, Homo sapiens
  misc_feature 4, 26, 28, 29, 30, 34, 35, 36, 38, 39, 46, 47, 48, 54, 225: n = A,T,C or G
ctgnaagcgtaaaatgattaggtccntnnngaannnanntcagaannnagagangtccacaatgctctctcaataattaatagaacaagtcaacagaaaatcttttaggatatagaaggcttgtgctatgttatcaaccaatgggcataattacaattttataaaaatgcttcatccttcaacagtgaatacatactctttaaattcaaatggttcacttacaanggttagaccatattatgggttataaaacaagtcttaagatggtgaaattaactagcaattagtaacaaagttatttccaaataaccgcatgagc

SEQ ID NO: 24935 - DNA, 130 bp, Homo sapiens
  misc_feature 28, 53, 84: n = A,T,C or G
gaaggccactatcatcctccgtctgctngcacaagtttcctgggctggaccgnatcaacagagaggcttattagactttatgcnagaagatgaggctgctgggataggcccagaagttcctgatgaccgc

SEQ ID NO: 24936 - DNA, 413 bp, Homo sapiens
  misc_feature 29, 229, 398: n = A,T,C or G
ccatttcagctgtcttttgattaatgttntcgtggcactcatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagccgggntatgtcttttctattctactgttatcacatttgtaccacttaaagtggaatctaggcactttatcaccatttagatcctattaccttttctcatctaggatatagttatcttctacataatcttgctgtatcttaaaacccatcaataaattattatatattttctacngttaaatcactcaga

SEQ ID NO: 24937 - DNA, 417 bp, Homo sapiens
  misc_feature 3, 18, 239: n = A,T,C or G
gcntgtggttaaatgtcnttgtttctatgattgtaaactattaaattctgttcctattaaagtacagatctaatctaagtattattaagttgatagccctctagtcagttatattgctattgtaaattcttgtttgttgagtaaaatgtttaaatactatatgtatctcatgtacaaagttgacatacattatattcatgtcataaaattaaagagattagattatatactgtcacttncccaagcagctaccttggtgtattcaatttctaatctgcctcaaaactgcccttctgtagtttgcaccaaaacagacccttttttaataattaaaaagggatgccccatctctctaaagttactatggcattagaaatagttattaaaatttgacttttgacgtgaatgggagccagc

SEQ ID NO: 24938 - DNA, 248 bp, Homo sapiens
  misc_feature 2, 46, 48, 165: n = A,T,C or G
anatccacagtactcactttttccaaatgatcctagtaattgcctntnaatatctttctcttacctgttatttatcaatttttcccagtatttttatacggaaaaaattgtattgaaaacacttagtatgcagttggataagaggaatttgggtataattatggngggtgattattttttatactgtatgtgccaaagccttactactgtggaaagacaactggttttaataaaagatttacattccg

SEQ ID NO: 24939 - DNA, 441 bp, Homo sapiens
  misc_feature 5, 10, 29, 110, 112, 113, 263: n = A,T,C or G
acggngactntgaagacttggaaacaggngacatgctttagggaaaatcgggccccgacactcagaatgaagatatagagaaacaagggaagaaattgaccccgacgganannaaagtgccaagaaaaagcatttggataagaagagaaaattgaaggagatgtttgatgcggaatatgatgaaggagaaagcacatattttgatgatcttaaaggagaaatgcagaaagaagcacagctgaatcacgtagaatttgaacgtnagatgatgaagccagagttcagtatgatggttttcgacctgggatgtcatccgcgttgagattgaaaatgttccctgtgaatttgtgcagaactttgacccccattaccccattatcctgggtggcttggcaacagcgagggaaatgttgacacgtgcagatgcgtctgaagaaacat

SEQ ID NO: 24940 - DNA, 197 bp, Homo sapiens
  misc_feature 21, 50, 164: n = A,T,C or G
ctagggcagccagggtagagnagtgcatttctacataaaaaagaaactgnatctttatatttttaaaaattgtttttgctgctcaagaaatggtaccctcttgtcaaaaaaggcatacattcataattgtaccattcagcattgtaaataatcttatgaaaccntttttgattgaagctattcaaaataaaaatttt

SEQ ID NO: 24941 - DNA, 423 bp, Homo sapiens
  misc_feature 3, 13, 28, 29, 37, 41, 45, 47, 81, 117, 270, 272: n = A,T,C or G
canggtgaaaccncgtgtctgctaggannacaaaaanaaantttncngggctgccatcaacgaagtggtaacccgagaatncaccatcaacattcacaagcgcatccatggagtttncttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggcngngcagaaaacgtaatgaggatgaagattcaccaaataagctatatactttggttacctatgtacctgttaccactttcaaaaatctacagacagtcaatgtggatgagaactaatcgctgatccgtcagatcaaataaagttataaaattac

SEQ ID NO: 24942 - DNA, 213 bp, Homo sapiens
  misc_feature 30, 66, 69, 120, 185: n = A,T,C or G
tggccaaagttttacacaattgaaaatggngtaaaacagacggcatgtgtttaaacctgagtttancantttggcaggaagttgcaggagagagaggcagtgacccaagccagtgcactngatgttcatggacatatattttttttaaataataaattaaaacattttaaatagaagcataaatngagttgtttgttggcgctgagatactgc

SEQ ID NO: 24943 - DNA, 100 bp, Homo sapiens
  misc_feature 16, 26, 28, 29, 43, 47, 79: n = A,T,C or G
gtagaaccgcgagggncagatgaaanannataaccgagcatantatntctaggactaacccctatacctgctgcataangaatgaactagaaatcactgt

SEQ ID NO: 24944 - DNA, 309 bp, Homo sapiens
  misc_feature 5, 21, 40, 41, 262: n = A,T,C or G
gcggnctgctgcaagagagantaggtaatctgcatcactnnagtggaagagatgcttcaaaaaatttctcctctacagaaatgtcaggaagaactgggatctttaaaagcagagctagaagagaaaaagagttctttaaagttgtatcaggatactcatcaggaatatgctcgtgtaaaggaagaatgcttgaagagtgatgctcagaagaagaaactagaagctaaggtgaagaagctgcaagaggctgctgtcaagcaanctcaggacttcaagcaactgagaaatgaaaagaaaatacttgaaaag

SEQ ID NO: 24945 - DNA, 138 bp, Homo sapiens
caggcggagcttgaggtttcccgcagataagtttttttctctttgaaaggattgagattaatacaactacttaaaaaatatagtcaataggttactaagatattgcttagcgttaagtttttaacgtaattttaatag

SEQ ID NO: 24946 - DNA, 413 bp, Homo sapiens
  misc_feature 22, 25, 29, 36, 64, 129, 251, 252, 373: n = A,T,C or G
tatcactgcggccttacggggntantttngcgtccngaagtatgagccactaacaaaagtccanaaactcccagttaatagtattgtgtctcttcaaaatatcggagaataatttctttctcgctgatngcctaacttctactgacgaagcttggaagttgcagaaggttggagtgcaatggcgcgatctcggctgactgcaacctccacctcctggattcaagctattctcctgcctcagcctgccggannagctgggattacaggcatgtgccaccgcacccagctaattttgtattttttagtagagatggggttctccatgttggcaggctggtcttgaactcctgacctcaggtgatccgcccacctnacctcccaaagtgctgggattacaggcgtgagccaccgcg

SEQ ID NO: 24947 - DNA, 228 bp, Homo sapiens
  misc_feature 41, 113: n = A,T,C or G
gagactggcctgagcaacatagcaaggccccatctctattnaaaggaaaaaaagaagaagaaggcatttttattataggagatgacagcttcatgagtgttatagcccttgangacctttcagtgggacaaaatatggaggtggaaaacagtgatattgatgatgctgaccctgtgtaggcctagactaatgtgtgtgtttgtgtcttcatttttaataaaaagattt

SEQ ID NO: 24948 - DNA, 366 bp, Homo sapiens
  misc_feature 1, 25, 30, 47, 279: n = A,T,C or G
naagaacccacacaaaggctgattnctaangtatactatgtatgcancgtgctttttcttgccagcttgggccattcttgcttagacagtcagcatttgtctcctcctttaactgagtcatcatcttagtccaactaatgcagtccgatacaatgcgtagatagaagaagccccacgggagccaggatgggactggtcgtgtttgtgcttttctccaagtcaagcacccaaaggtcaatgcacagagaccccgggtgggtgagcgctgcttctcaaacnggcgaagttgcctcttttaggaatctctttggaattgggagcacgatgactctgagtttgagctattaaagtacttcttacacattg

SEQ ID NO: 24949 - DNA, 427 bp, Homo sapiens
  misc_feature 275: n = A,T,C or G
atcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttacngaggactgtacaaacatgaaggtgtggtatcaaacttcaggttgaaactgtttgaagcattataaacattcatttcacaactagattgtataaggatattaagctgtgatgagactcactgcattatttttttttagtgaatttatgaaatc

SEQ ID NO: 24950 - DNA, 297 bp, Homo sapiens
  misc_feature 19, 47, 122: n = A,T,C or G
cacaggtgaacctatgggncgtggaacaaaagttatcctacacctgnttagaagaccaaactgagtacttggaggaaccgaagaataaaggagattgtgaagaaacattctcagtttattgnatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaacaaaagaaggatggtgac

SEQ ID NO: 24951 - DNA, 458 bp, Homo sapiens
  misc_feature 49, 123, 277: n = A,T,C or G
catgaaagggctcaagtgctgtggcttcaccaactatacggattttttngactcaccctacttcaaagagaacagtgcctttcccccattctgttgcaatgacaaccgtcaccaacacagccnatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtntctgtactgcaatctacaataagtccacttctgcctctgccactactgctgccacatgggaactgtgaagaggcaccctgcaagcagcagtgattgggggaggggacaggatctaacaatgtcacttggccagaatggacctgccctttctgctccagacttggggctagataggggacca

SEQ ID NO: 24952 - DNA, 386 bp, Homo sapiens
  misc_feature 46: n = A,T,C or G
ctgcatagcaatttgataacttcagtaattcctaggtaaggtgaanttttggttgtttcaaaaggaggggagagcaaagccagctgatagtcttatagatggccccacaaagctggtggcattagggttggctggaaatgacgagcaactgcctcaaaagtgaagatctgaggtggagcagggctcagcagagagtgagcaaccagaaagaaacatgggctgtgatctggaaatgttcactgggtcacagcccagacacttggagggaagcaggtagagacattcttgcctgtattaactctttttcattggaattgctgcaaatcaggtatgcttcattctatattattgactttttggagcttaaatacaatttggttgatctt

SEQ ID NO: 24953 - DNA, 455 bp, Homo sapiens
  misc_feature 45, 48: n = A,T,C or G
aaagaggtccttatacgtacagagttcgttttctagccaaggaanttntaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaacctattgatggattaaacccaaatgaagaagaacataggacatacttggatattgaacctataactggattcactttacaatttgcaaaacggctgcaggtcaacctattggcaagccatcagaaaaaattcaagtattaaagaatctgaagaggaactatattgtgcctattctttggcttaatgagactggg

SEQ ID NO: 24954 - DNA, 277 bp, Homo sapiens
agagcgagctgagtggttgtgtggtcgcgtctcggaaaccggtttcgcttgcagcatggcttgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggc

SEQ ID NO: 24955 - DNA, 454 bp, Homo sapiens
  misc_feature 24, 30, 45, 76, 118, 119: n = A,T,C or G
gaatggtgtaggaacacgatgaanctattntgaagcacttgaaantttttaaagtgaagttctcagatgctggccngcctatgagttttgtcttagaatttcactttgaacccaatgnntattttacaaatgaagtgctgacaaagacatacaggatgaggtcaagaaccagatgattctgatcccttttcttttgatggccagaaattatgggttgtacagggtgccagatagatcggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctgggatgatgatgctgaagctatccttgctgcagacttcgaaattgggtcactttttacgtgagcgg

SEQ ID NO: 24956 - DNA, 431 bp, Homo sapiens
  misc_feature 3, 5, 29, 41, 349, 389, 407: n = A,T,C or G
ganantttatggaagcttcatgatgtttncattctttcctncagtgtataggatgggatcctctctggggagggtcttaagacccacaattagaaaggcaagggaagattaagaagtcctgctttggggtaagatgaaaggaaaggagagagattctgtttcctgaggcttaatacacccaacattataacaaaggactgtagcaagggctatgggagttctgaagcagaaaccatgggctaaaaccaacatacatcttaataccagataccctaatcccagtcctaacttcatttaaccttggcacattgagtcattccaggatgaagtggctcaagtatttcctcanggaaaatacttctgtgccccctgatttgagggtaagaagnaagataatgaggccctgngggggtattttttcatgtctggac

SEQ ID NO: 24957 - DNA, 149 bp, Homo sapiens
ccacttgtatcaatattgtccctgttcatcgtcgccaggactgcatcttgcaccactgtgccgtcttctaggcacacacgacccgttatctcccttggaaaaattcctctcactggaaatgtacaattaaaggatgattgaaatgtttc

SEQ ID NO: 24958 - DNA, 468 bp, Homo sapiens
  misc_feature 57, 58, 285: n = A,T,C or G
aaaatgtcctttaaaatttgggagaattgtaaaacaccattatattttttcagattnnttttaaaatttattttgtacaaaatatttatagatatgaggcttcactttgttgaattcatcatacacacacacttctttttagcagaaattaatagaaagccaattctaaattaatgtaggtaatacataatctactcaactggatgaataccttggttgcaagtcttgtcctgagcgagctaagtgacaacactctcaatctactgagcttccagcatctaggcngagctcccaggacaagcagaagtcacagggaacaggaagcaggaaagagcaggaaaagattctttagttcccatgtgtaggaaacaaatgctcagctgcctctgtattgaaccatactgatgcctgccactatattgtcattgtagatagaaatcattataagttgcagtcgattagaaattg

SEQ ID NO: 24959 - DNA, 128 bp, Homo sapiens
tcgtccgacttatatgacattgaaaacttgtgtgtgcaacttttgggggacaggaatcacttaaaatcatatttatttggctttttatttaaaggattctgtcacaagtcttattgaaaagtagattg

SEQ ID NO: 24960 - DNA, 301 bp, Homo sapiens
  misc_feature 57: n = A,T,C or G
taaatttccaactgtcatggcactggtgagagtgtcttttaccatgctaatgtattngaaccttaaggatgaccagaggttgctttcgttgccatcttggtttttgtgcgttcttctggctgctttacgcatctcattttaccagtggggtctttgagatttgtaccttgtaaaaccagtcctgccaaactcctgtctcatcatgagagaatcaagttgagccaaggaggttgaggctgcagtgagctgtaatcatatcaccacactccagcctgggtgaccggagcaagaccctgtccca

SEQ ID NO: 24961 - DNA, 462 bp, Homo sapiens
  misc_feature 33, 57, 59: n = A,T,C or G
gaaattgcccgtaaacacaaaattatcagtgtnttagaaacatgagtccggactgtntnagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgcttaaacctcactgagagcgcaaaatgcagctttatactttttactttcaattgcctagcacaatagttgagtacatttggaattg

SEQ ID NO: 24962 - DNA, 451 bp, Homo sapiens
  misc_feature 24, 57, 362: n = A,T,C or G
gaaactgccaaatatgctttcagntcatacgaatccccatgactttcacatcttctntttagtctgttggtggatggaatatgaactctctggcctttctccatcattctggaagtgagaggagatgggacattataatgctcttcatcaaagcatggccctgtcagcatagctggtagtgtagctccatttaatgtggttactttaatctaggcattcacttataatgcccacttcatattatctgataaatacttggatagagatatgacacagaggttaagaactaagagttaacttttttttattaagtttcagagccctataagaataagcatcgcaaataaaaatgttggtagcgnccggaaatttgcaattgcattcttaacccttctccatccttgccaccaaccccaaagatctatgagattagtctatgagattcggcctt

SEQ ID NO: 24963 - DNA, 146 bp, Homo sapiens
  misc_feature 31, 74: n = A,T,C or G
catggtggcacatgcctgtaagtcccagccncttgggaggcttgaggtggggagggattgcttgagcccagggnggttgaggctgcagtgatccatgatgggtgtcactggcctccagcctggatgacaggaagtgagactttgtg

SEQ ID NO: 24964 - DNA, 286 bp, Homo sapiens
  misc_feature 9, 58, 276, 282: n = A,T,C or G
atttttccnaaaaaaaaagtcctcaaatcaggaagaaacatcaaagactatgtccttntggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgccaaanaaaaanaacg

SEQ ID NO: 24965 - DNA, 424 bp, Homo sapiens
  misc_feature 13, 16: n = A,T,C or G
gcggagcttgagnttnccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggttctaaaacatgacggaggttgagatgaagctcttcatggagtaaaaaatgtatttaaaagaaaattgagagaaaggactacaggccccgaattaataccaatagaagggcaatgcttttagattaaaatgaaggtgacttaaacagcttaaagtttagtttaaaagttgtagggtgattaaaataatttgaaggcgatcttttaaaaagagattaaaccgaaggt

SEQ ID NO: 24966 - DNA, 441 bp, Homo sapiens
  misc_feature 2, 15, 27, 38: n = A,T,C or G
gncgcttgcaatggntgcccgtggtgncatcgctcctnttggcgagagtttgcgctacgctgagtacttgcagccctcggcaaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactccttgttgtcagaaaatggtctgcagtggcttatacctagcttttcatcctactataaaggaggatttgaacagaaaatgagtaggcgagaagctggtcttattttaggtgtaagcccatctgctgcaaggctaagattagaacagctcataggagagcatgattttgaatcacccagataaaggtggatctccttacgta

SEQ ID NO: 24967 - DNA, 207 bp, Homo sapiens
  misc_feature 2, 22: n = A,T,C or G
tnactttgttgccctggctggntttgagctcctggcatcattcgtttcctccccactggcctcccaaagttctgggattacaggcatggccacagcaccaggcctcttttttattttccactttaccgttctattaaccagtcttttctttttatctgaaactaaacattaatgactaaacattattggataaaattatttgcagca

SEQ ID NO: 24968 - DNA, 447 bp, Homo sapiens
  misc_feature 45, 48: n = A,T,C or G
cgttgcgaaaagtaagagatgctttatatatttccttggtatatntantttttgttccttccttaaagtttatattttatatttacatctgtaggatatatttgcttctcaggagcttatattaatgtaaagctcatcattattttatccaaatttagataattttatattgaagcctttcttttgaacctgacttacacttttagcctcaggagtgtgagattaaactataggaggagaatcaaacttctgcttttgataagaactgttgaatatcaaaataactgttaattcagtataatttaaagaaatatctttaatagacaaaattgatgagcatcaaaaatagacatgataatatgtaaaggtaataacttttattatattaaagcaatgcaaacgaaaaacagaattgagcagtgcaaaatttaaagggactggtttggt

SEQ ID NO: 24969 - DNA, 454 bp, Homo sapiens
  misc_feature 56, 276, 418: n = A,T,C or G
aaataagccttgtaagatcccacccaacctttaataatacctttccctcgggggcnttgtaaggacttaaagatcctgtacatgaaaaaacattgtaaagtaccatgcaaatgctagttttttacatcgaattccatctattaataatcatctaaattcaagcattttctgttactagattattagctattaggtttattaatattttggtaatagatggtatgattatagtggaatttatttgtaacaggatttagcctatacttgttaatattntggttgcctaacctgggatttctcttagtgtcatagccccagtataataacgtcgataacaggcattcaagaaagatttattgtttaaagaaagttgtgtaaaccttctgcatagattaaattgaattgggttatttcttgnaatatttcaaaatatgttaagagatctggtataatt

SEQ ID NO: 24970 - DNA, 458 bp, Homo sapiens
  misc_feature 2, 57, 130, 282: n = A,T,C or G
anattcccccctctacaaccctctctcctcagcgcttcttctttcttggtttgatcntgactgctgtcatggcgtgccctctggagaaggccctggatgtgatggtgtccaccttccacaagtactcggncaaagagggtgacaagttcaagctcaacaagtcagagctaaaggagctgctgacccgggagctgcccagcttcttggggaaaaggacagatgaagctgctttccagaagctgatgagcaacttggacagcaacagggacaacgaggtggganttccaagagtactgtgtcttctgtcctgcatcgccatgatgtgtaacgaattctttgaaggcttcccagataagcagcccaggaagaaatgaaaactcctctgatgtggttggggggctgccagctggggccctcctgtcgcagtgggcactttttttttccaccctggctccttc

SEQ ID NO: 24971 - DNA, 412 bp, Homo sapiens
  misc_feature 7, 11, 54, 55: n = A,T,C or G
cagcccngccnacatggtgaaaccccgtctctgctaaaaatacaaaaattagcnnggtgtggtgacagcacatctgtagccagctacttgaatcgcttgaacctaggaggctgcagtgagccgagatcgcgccactgcacttcagcctgggtgacagagtgagactccgtctcccaacaacaacaacaacacccataaaaacccatcccaaatgttcagcatactacctaagagtattatgggtctgttttcgagaatgcaaaaataatggtcagtttatattattaaaatgtccgtaaaacctaggtattttgtgatattctttattaagtagcaagacatataacggaaagtaagttaagctatgatttaatttaaaagctattcagtatacttcaaatgacataaatcc

SEQ ID NO: 24972 - DNA, 390 bp, Homo sapiens
  misc_feature 1, 58, 289: n = A,T,C or G
naaaagctccccgtcatctagccctcttaacattgctctataggaatagggctcagantatccatgaagaaaagaaaaaaatgccgataccctggttactatcatttgtctctgactcaggagtctcatgtcttctaacagcatccatgaaactatagtgtggtaacttgttagctagtaagtagggtaaaatctcatacccttcacagttattgacacccattctttagcagataactgatatttcacaattatagacatctataggccaggcacggtggctcacgcntgtaatcccagcactttgggaggccaaggcgggcgaatcacgaggtcaggagatggagaccatcctagacaacatggtgaaaccccgtctctactaaaaat

SEQ ID NO: 24973 - DNA, 453 bp, Homo sapiens
  misc_feature 1, 56, 325, 359: n = A,T,C or G
naaatacccatagtaccgcaagggaaagatgaaaaattataaccaagcataatatntcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgccaagatagaatcttagttcaactttaaatttgcccacagaaccctctaaatccccttgtaaatttaactgntagtccaaagaggaacagctctttggacctaggnaaaaaccttgtagagagagtaaaaaatttaacacccatagtaggccttaaagcagcccccattaagaaagcgtcaagctcaacacccctacccc

SEQ ID NO: 24974 - DNA, 408 bp, Homo sapiens
  misc_feature 3, 39, 41, 260: n = A,T,C or G
cgnaggggcttctgctgagggggcaggcggagcttgagntnccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttctncatggagtaaaaaatgtatttaaaagaaaattgagagaaaggactacagagccccgaattaataccaatagaagggcaatgcttttaggattaaaatgaaggtgacttaaacagcttaaaggttaagtttaaaagttggtaggtgatt

SEQ ID NO: 24975 - DNA, 179 bp, Homo sapiens
  misc_feature 178: n = A,T,C or G
ccgaagaaaagaatagagaaggtagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatng

SEQ ID NO: 24976 - DNA, 152 bp, Homo sapiens
aaaagaatagacactaaaatcatgttgatctataattacacctatgggatcaataagcacgtcagactgattaatgtctactgtgaaaatttggtagtaaattttcatttgatattagatataaatatctgaatataaataattttaatata

SEQ ID NO: 24977 - DNA, 462 bp, Homo sapiens
  misc_feature 279, 420: n = A,T,C or G
aaagtggcccctgaagttggggcttctatctctgcctaagatcttttcccctgattttctcctgattttgaggattcatcatgttactttttttaaaatgtgatttcctgtcttatgtgcctgaaagtgtcatagcacacttgatgtcttctatttacaggccacttgacttcaaataatggagagaggaaaagagaatgaagcatctggtttatgaagaaatgcacatgaaatagtcaaacaagagaaatcttattggttgtcctttttaaaaaatgnccctttgcacaggagaatgctgtgggtcttcacgtggctctagaatagaatttactttatcctaaatgggacctgtgatgaatggtacagaaacagaagactagaaagctttcgcctatagaagactcaaggcagggtganggccgactgggtgtctgggagagaccttctactctgctatta

SEQ ID NO: 24978 - DNA, 180 bp, Homo sapiens
  misc_feature 17, 46, 117, 118: n = A,T,C or G
ctggtggtgcagaagtnagaaggtaaagcttgagaagatgaggttntttacgtagaccagaaccaatttagaagaatacttgaagctagaaggggaagttggttaaaaatcacgtcnntaaagctactaaaaggactggtgtaatttaaaaaaaactaaggcagaaggcttttggaagag

SEQ ID NO: 24979 - DNA, 245 bp, Homo sapiens
  misc_feature 2, 4, 58: n = A,T,C or G
ananggtcccctgaaggtgaattcaaggctgaaggaaatagcaaattcacctacacanttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatc

SEQ ID NO: 24980 - DNA, 469 bp, Homo sapiens
  misc_feature 1, 285, 465: n = A,T,C or G
naatacccccgaagatactggaaaagctcttgtttgtcaaggctaagttacatattgttgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccnttaatttctacaaaaatggaagattctggggtttatttatgtgaaggaattaaccaggctggaagaaagcagaaaggaagtggaattaattatccaaggtactccaaaagacataaaacttacagcttttccttctgagagggcaaagaaggagacctgcatcatctcttgacatgtggnaatg

SEQ ID NO: 24981 - DNA, 458 bp, Homo sapiens
  misc_feature 9, 16, 56, 278: n = A,T,C or G
aaaagaccncatgaanacagctggatgttcattgcagtctgaagccttgaccgttncagtctctactgaactcagcctaacacataagagtaaagaaactccaattgagtgttgtttgttgggagaaaaatggaatgaactaagataaagacagaccagtacactaaagcctaagcattccctcttcccccaacgttatgtttttttgaaattttgatggaaaaatatccagcatggtggagtggtgtttcgaagatgggtttgatcacacatacttngtcgtacgtatctacccaagctgtcactattcgctaaagtttaaaatgttcttttcctttctccaaagtaatctacattcttttcttccagccgaccccttggtgggaagtattgccactcagtatatgaccaacagagcagaacatgcagaatggccagacagtggaccaagagatcgc

SEQ ID NO: 24982 - DNA, 454 bp, Homo sapiens
  misc_feature 12, 20, 56, 278, 450: n = A,T,C or G
aacagtcccaangaggaatntggtataattatggtgggtgattattttttatactntatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactggtngggtttttgcacttcatctcttcactaatggagatagctttacactttctgctttaatagatttaagtggccccaatatttattaaaatgctagtttaccggtcagaagtataatagaaataatcttagttgctcttttctaaccattgtaattcttcccttcttccctcancttt

SEQ ID NO: 24983 - DNA, 422 bp, Homo sapiens
  misc_feature 9, 10, 360: n = A,T,C or G
aagaatggnnctttatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcagggatgagattcagaatatgaaggaggaaatggctcgtcaccttcgtgaataccaagacctgctcaatgttaagatggccttgacattgagattgccacctacaggaagctgctggaaggcgangagagcaggatttctctgcctcttccaaacttttcctcctgaacctgagggaaactaatctg

SEQ ID NO: 24984 - DNA, 300 bp, Homo sapiens
  misc_feature 3, 285: n = A,T,C or G
aanaagtcccggagaaatatagaagatagaaaaatataaagccaaaaattggataatttagcactgaaaaaaatgaggaaattattggtaaccaatttattttaaaagcccatcaatttaaattctggtggtgcagaagttagaaggtaaagcttgagaggatgagggtgtttaccgtagaccagaaccaatttagaagaatacttgaagctagaaggggaagttggttaaaaatcacatcaaaaagctactaaaaggactggtgtaatttaaaaaaaactaagngcaggaggcttttgg

SEQ ID NO: 24985 - DNA, 461 bp, Homo sapiens
  misc_feature 3, 8, 46: n = A,T,C or G
cancgagngcaggggcttctgctgagggggcaggcggagcttgagntttccgcagataagtttttttctctttgaaagatagagattaatacaactacttaaaaaatatggtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatgcagtgaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaacccgaaggggt

SEQ ID NO: 24986 - DNA, 463 bp, Homo sapiens
  misc_feature 10, 22, 57, 284, 285: n = A,T,C or G
aaacaaaccnctattgtagcanaactgcattgttggcagcaaaatgactggctggtntctttcttagtacaaatcatacctcccaaggtattgctccattgtgtttttgtgcatttggtttggatttttatggggaattgaagacaagtggatcataaagtgcaaaataaaatgctctagaaatgacagatggggcacaatttccaagaaaattcatctagacagtggcaacactgagaaaaaaaagaaacattcaagaagggagttacagtttcagacatccnnagttttggttaaaaaggtcccttttgatgagtgtgcagtcactaccagctagaacaagggccctaaagtgagggccaaccgtatataatcagagagcctgacgtcaggttgatctgaaaatatgagaactaaatggcattctaccagctttagtttagaagatatagcatgtttgatg

SEQ ID NO: 24987 - DNA, 407 bp, Homo sapiens
  misc_feature 71, 222: n = A,T,C or G
ccttggcccagatagagaactcagctgcagtgcaaaaggctattgcccactatgaacagcagatgggccanaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagngggatgacttttgtaaacagaatcaggaagcatcatcagatcgttgctcaggtttacttcaggtcattttcagtcctctagaagaagaagtgaaggcgggaatttattcgaaaccagggggctatcgctctttgtcagaagctacaagacctgaagaaaaaagtctatgaggacccgaggaaggg

SEQ ID NO: 24988 - DNA, 424 bp, Homo sapiens
  misc_feature 6, 18, 89, 90, 373: n = A,T,C or G
actcangcataatatttntaggactaacccctataccttctgcataatgaattaactagaaataactttgcaaggagagccaaagctannacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaangcagccaccaattaagaaagcgtcaagctcaacacccactacctaaaaaat

SEQ ID NO: 24989 - DNA, 453 bp, Homo sapiens
  misc_feature 6, 24, 38, 45: n = A,T,C or G
taatcncagaagatctttgtgggnacaaaaggaatccntcatttngtgactcatgatgcccgcaccatccgctaccccgatcccctcatcaaggtgaatgataccattcagattgatttagagactggcaagattactgatttcatcaagttcgacactggtaacctgtgtatggtgactggaggtgttaacctaggaagaattggtgtgatcaccaacagagagaggcaccctggatcttttgacgtggttcacgtgaaagatgccaatggcaacagctttgcactcgactttccaacatttttgttattggcaagggcaacaaaccatggatttctcttccccgaggaaagggtatccgcctcaccattgctgaagagagagacaaaagactgcgggccaaacagagcaagtgggtgaaatggggtccctgggtgacattgtcagaatctt

SEQ ID NO: 24990 - DNA, 319 bp, Homo sapiens
  misc_feature 45, 70, 78: n = A,T,C or G
gatgtcaatgtccaggacatttctgggatgggaaagggatgtganatgatctgatactgcaacttcagcnaattgctntgctgcccaaaagacgttttctttggaccaaagatctctttcgtgattccttgcaacaatcaatgagaatcttcatgtattctggagaacgccattcctgatttcccacaaactgcactacatcagtataactgcatttctagtttctatatagtgcaatagagcatagattctataaattcttacttgtctaagacaagtaaatctgtgttaaacaagtagtaataaaagttaattcaat

SEQ ID NO: 24991 - DNA, 400 bp, Homo sapiens
ccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgcaattatatattcctactcggcatactggactggcttcgttctcttaatatactcagtaatgactcaagcctctggctattaacataccctagttgccggtttttaattgccatgagccaaatacttc

SEQ ID NO: 24992 - DNA, 110 bp, Homo sapiens
  misc_feature 14, 18, 27, 31, 50, 81: n = A,T,C or G
gaaataccttgaanttcnagacttgtnaganctacaagcggttgtgctancttaattctgtgttcccagaaataaaaattncccttagttatgctgtcatttttaactaa

SEQ ID NO: 24993 - DNA, 253 bp, Homo sapiens
  misc_feature 15, 20, 27, 35, 43, 66, 97, 182, 195, 218, 236, 246: n = A,T,C or G
aatgatcccggcaanagagnagcaganaaattacncacacatntgtgcttggagctttttgccttnggaaagaaccttttgcccagagtagcagccnaacttgaggttgccccgatttctgacatcattgcaatcaagtcacctgacacatttgtgagaactatttatgccggaaatgctcnatgtacagtgaantgtgatgagaaagtgaaagtgtnttctgtccgtggaacatnctttgatgcngctcaac

SEQ ID NO: 24994 - DNA, 302 bp, Homo sapiens
  misc_feature 3, 10: n = A,T,C or G
ccnatagtgntagtgaaagttacaattacttcctttatggagtgaagcttaactatagaaaacattgtcctttcatctgtaacagttgcttaaggtaacagagacaattccatccgaaatttcactatactgtagcatatgactcctactattttaaatatgtgctccaagtatttttcatatggctagttccccacccccacacctggttttcattctttggtttaaaagaaattttaaattattaggaatagtataactaaaatatttgattaacagaaaggagataagcaaagacactt

SEQ ID NO: 24995 - DNA, 306 bp, Homo sapiens
  misc_feature 10, 11, 261: n = A,T,C or G
gtttgataannattcgacatccctttgtgacaaaagctttcaaaaactgggtataaaagagacatacctcaacaccataaaagccatatatgacaggtccacatgaaatcctttcctctaagatctgaaacacaacaaggacacccacttcataactgttactcaacatagtactggacatcccagctagagcaatcagacaagagaaagaaataaaaggcacctaaactggaaaggaagacatcaaattattcttgtttnggagatgacatgatcttatctttagaaaaatatgaagactctacc

SEQ ID NO: 24996 - DNA, 462 bp, Homo sapiens
  misc_feature 10, 14, 53, 55, 281, 412: n = A,T,C or G
aaattccatntacnaactctgctaattataccctctgagtctgtatttccagntntttattagaacacaacattacctacaggagagttgatttctaaatcagattgagtttccccacacacctctttcctctcccgggagactcaattgggtatctacatgtggcagcaaaaccagaccaaccaaattattctacagttctgatgcatcatggcaggttaagacagtagcctagccagtggggaaagatgtttacaagggcccactgattataccacctnggagatcccagagaatgattcagacctgccaaagttttttcttcaaccgatgctgcctccgcatgtttgtgtcatctgatgggcagtcttaccataactcatgtagggcatatattatcatttgtggctgnctctttctgaatcagcatttaccttgtagtaagactggtttgccacacac

SEQ ID NO: 24997 - DNA, 403 bp, Homo sapiens
  misc_feature 29: n = A,T,C or G
catcatatagacaaaacagccctgctgcntaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctgccattaagagatgcaagcattttgaactgggaggagataagaagagaaagggccaagtgatccagttctaaactttgggatatttttcttcaattttgaagagaaaatggtgaagccatag

SEQ ID NO: 24998 - DNA, 236 bp, Homo sapiens
  misc_feature 5, 18, 33, 35, 36, 44, 45, 48, 53, 54, 55, 77: n = A,T,C or G
aaagncgactgcataagntttctacatcatttntnnatgtattnnttntatannncatgaagtgtatatataatggngtgaaaaattcctttggaaaaatttatgttcctttcatttttaccaaattgcaaattttcagcatggatgagaaaagcattaaaattataactttgtgtacaagatgaaaataattcactaaatttgcccttttttacacaaaataaaatgttaaagtt

SEQ ID NO: 24999 - DNA, 205 bp, Homo sapiens
  misc_feature 28, 30: n = A,T,C or G
caagaccagcctggccaacatggtgaancnccatctctactaaagatacaaaaaaattagccgggcatgttagcatgcacctgtaatcccagctacttaggaggctgaggcaggagaattgtttgagcctgggaagcagaggttgcagagagccaagattgcaccactaccctccagcctgggcaacagagtgggactctgtctc

SEQ ID NO: 25000 - DNA, 108 bp, Homo sapiens
  misc_feature 3, 13, 23, 41, 47, 53, 59, 61, 75, 78: n = A,T,C or G
gangactatcctnagcaattttnactgccgacattccaaanaacgtngacctnactctnangggacgcacagtgnatnagtgaaggccccagattttccctgcggagg

SEQ ID NO: 25001 - DNA, 238 bp, Homo sapiens
  misc_feature 14, 24, 33, 35, 37, 40, 42, 43, 45, 52, 59, 64, 66, 75, 83,116, 124, 125, 203: n = A,T,C or G
tgaaagcgcttgcngcatggatgnccaactgantnangancnnanggcaganttcaaanaactntntcactattngacaaagntggcgatggaactataacaaccaaaggaattgngaactgtnntgagatctcttgggcagaatcccacagaagcagagttacaggacatgattaatgaagtagatgctgatggtaatggcncaattgacttccctgaatttctgacaatgatggcg

SEQ ID NO: 25002 - DNA, 500 bp, Homo sapiens
  misc_feature 10, 11, 48, 49, 51, 62, 76, 359, 420, 484: n = A,T,C or G
ccaatggatnnttaattcattatggcaataggtacattccaaagggtnncnttttttaaaangagatttttctttngggcctaagattacagtcacatggttccaaattcagagggttcaaaaggacacagaaaagcctgcctcccacttgtgcccactggcctccccttttttcgcataaatggcagtttatagctttgtctgttccttgttttttgagcttaataccttagagacagatttttgtatatctgtacctgcagaactttgtttttcttttttatggcttctgagaatttggttatatgaatgtaccagaatttattagcaactttccctattgatggctcaattaatanggttggttctaagactttgctgtggcaacctgccctccaggtgaattattatatgcattgncatttcatgcatgtccgcgtgtatctgtaggacagatcctaaacgtgagatgctacatcagcanggtatgtgcatttgta

SEQ ID NO: 25003 - DNA, 500 bp, Homo sapiens
  misc_feature 9, 12, 32, 51, 82, 125, 262, 371, 449: n = A,T,C or G
tgtgtgatnctntgttgtatttcctcagggantccaaggaggagagtcagnggaagctacatgttagctgagcatgagaaanaattttctgctagagtaagctgatgatggcagttgtgcctcanacttaacccatcagtggagtttctagcataggccagaaaaacacttggtgggaattttgggaaggaaatttaaatatagaatgattgattaaactaggatgcctttcccggacctgagagccgtaaactgacaagtnaatgctccatgatgacaaaccccaagactatctgctgaagttcctcagaacctgagatttatgtttcttttgctctccagagaagcctctcattgaaagggaagattangagaaaagaacttacaatgacagtaggtgcaagctctcagatcttacacttgagttctaaaatgacagacaaggttgnaagaaaaatccatgcaagaactgatgaagataactcctaagaaaatgtttc

SEQ ID NO: 25004 - DNA, 100 bp, Homo sapiens
  misc_feature 5, 10, 27, 49: n = A,T,C or G
caagnaccgnctgaggaatctgcaggnttcatctgaaggcaccgtatcnctcgtggccataaagggcaaccaagagagccccaaagccactggagacttt

SEQ ID NO: 25005 - DNA, 100 bp, Homo sapiens
  misc_feature 2, 3, 10, 30, 35, 45, 79, 99: n = A,T,C or G
gnntctatanaagaattattcatagatcanacatnaagagccatntgcccaacacagataacagcacaaaaaaagaaangctcagttaatgagtctgana

SEQ ID NO: 25006 - DNA, 500 bp, Homo sapiens
  misc_feature 13, 15, 28, 43, 79: n = A,T,C or G
gtgttataaggananctaacaaacaganaggacatccactttnaaaacccatctgcacatcaccatcatcaaagaccanaagtagataaaaccacaaagatggggaaaaacagagcagaaaaactggaaactctaaaaagcagaacgcctctcctcctccaaaggaactcagctcctcaccagcaatggaacaaagctggacggagaatgactttgacgagttgagagaagaaggcttcagacgatcaaattactctgagctacaggaggaaattcaaaccaaaggcaaagaagttgaaaactttgaaaaaaatttagaagaatgtataactagaataaccaatacagagaagtgcttaaaggagctgatggagctgaaagccaaggctcgaaaactacgtgaagaatgcagaagcctcaggagccgatgtgatcaaccggaagaaagggtttcggtgatggaagatgaaacgaatgaaatgaagcaagaagggaagttt

SEQ ID NO: 25007 - DNA, 500 bp, Homo sapiens
  misc_feature 29, 31, 360, 467: n = A,T,C or G
taaaaaatatagtcaataggttactaagntnttgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggngattaaaagaccttgaaatccatgacgcagggagaattgcgcatttaaagcctagttaacgcatttactaaacgcagacgaaaatggaaagattaattgggagtggnaggatgaaacaatttgggagaagatagaagttt

SEQ ID NO: 25008 - DNA, 498 bp, Homo sapiens
  misc_feature 18, 33, 51: n = A,T,C or G
gcaatccgggccacaagncacttgtatgacttnaactccacatagcgggantagtactgtattacagaacatttgaaaggtcctggagcagctatgggccagaataccaaccctcatacaagcactgtgggtttggtgcattccttagattgaagacagtttttcattgagagtttttaccttcatttaataaatccctttcgtcagtgccgtgcaggagaacttaggactttgcagcattccattcaggaactgggccaggtgacaagcagtaggtgactcatcttcacatgctctaggcaagagtccctgcccagtttccaggccattgcaaggctggagagatgaggctctgggagaggcttgtggctcctgggtgacagaactgaatggcctcctgggagtgggggcttacgcctctaatcccaacactttgggaggctgaggtgggcaagatcacaaggcaggagatcaaagaccatcctggccaacatgggg

SEQ ID NO: 25009 - DNA, 262 bp, Homo sapiens
  misc_feature 18, 26, 28, 30, 38, 47, 50, 260: n = A,T,C or G
gattggcaggatcctggnatccgctngnangtcaaaangcagatctncgngaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgctgagaggngg

SEQ ID NO: 25010 - DNA, 124 bp, Homo sapiens
  misc_feature 9, 29, 38, 70, 100: n = A,T,C or G
atctgagcngaggaacaaagctaaaggcngtaccttanatagcagggaaaactgtatttaacatatcctncagtgagctcatctcacactgtagcctctnccttaaaatttgcggagctcctgt

SEQ ID NO: 25011 - DNA, 456 bp, Homo sapiens
  misc_feature 31, 33, 52, 87: n = A,T,C or G
gcaatccgtttttacagatgttaaaagaccngnctatcgagttaaggagatnggcagcaccatgtctggcagaaaggggactgatgnttccatgaccctgcagtcgcagaagttccagataggagattacttggacatagcaattacccctccaaatcgggcaccacctccttcagggcgcatgagaccatattaaattctatttactatttgttgaatttatttttccgtcagctatgtaaaataaacatactcttcttcctcccctgattattgccattaagcctttaaattctaaacaaattataatgcatcatctatttaggagttagatttggatgtgctattgtatgattaccgaatagtctgtatgtttcaagcccttctgtaaaatatgaagaaaagtgctcttagcattctgtgtaaaactgtactgttaaatatatgtgtgtaatc

SEQ ID NO: 25012 - DNA, 310 bp, Homo sapiens
  misc_feature 30, 35, 36, 292: n = A,T,C or G
aattgacctgcaaagttaaaaaaaaattantgttnntaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtnttaaagctccttagccag

SEQ ID NO: 25013 - DNA, 500 bp, Homo sapiens
  misc_feature 4, 29, 30, 43, 52, 395: n = A,T,C or G
tatntcagtatctgctacggtaacttcanntttctttcaaganggcgatgcnagcggccaagagggccgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgactataatgccaacagggcatttcagaagatggacacaaagaagaaggaggaacagttgaagcttctcaaggagaaatatggntcaacacagatccaccaaaataaatgttttctacattttcatttggactaaatcccacgaatgaaaaataccaactttttttcctttttaattaatactaaatat

SEQ ID NO: 25014 - DNA, 269 bp, Homo sapiens
  misc_feature 5, 14, 42, 77, 79, 81, 82, 92, 93, 106, 110, 111, 172, 180,204, 220, 259: n = A,T,C or G
actangaaccaaantacccctgcttgccccaaaacctatggntacagaaaattgagaagatgatatgaaagggggtntntnngaggggggcnnaggacatgagaanacanncctcaaaagaagaccaacaaatggccaacagggatatgaaaaagagctcagcaccactaancatcaganaaatgcaaatcaaaaccagagtgncataccatcttacctnaggcagaatagctattatttaaaaaaaaaacaacaagtngcagatattg

SEQ ID NO: 25015 - DNA, 489 bp, Homo sapiens
  misc_feature 33, 39, 41, 43, 46, 49, 52, 56, 72, 73, 76, 84, 93, 96, 142,155, 441: n = A,T,C or G
atgatacaaaagtgaaacgaatactgaggagcnaatatngntntcnganatncganagagagatattggaannggntgtttttnggcttggcnccntttatatgtaattgctgcttcattaggacttggaagagtttcctgnggttaaatttaancaaatagctcagaataacaaacttgtacactcaaaattccaggacagttctctataagaagcatggttttcctaagtttaaaacaaacacatatacacacatgcacacacgtaaacacacacacatcactaccaccaccaacaactagtttgtaaaatgctgtgagtgccatctcaaacctaactccctattggtagtgatttaataaatgatcatgtatagaagtataaggcataagagcgaaaccccatctctactaaaaatacaaaaattagccagatgtggngcatgtgtaatcctagctctctggaggctgaggcaggagaattgcttg

SEQ ID NO: 25016 - DNA, 261 bp, Homo sapiens
  misc_feature 4, 29, 30, 36, 37: n = A,T,C or G
tcantcaaaactgctcaactacatggaanntgaacnncctgctcctgaataactactgggtacatgacgaaatgaaggcagaaataaagatgttctttgaaaccaacgagaacaaagacacaacgtaccagaatctctgggacacattcaaagcagggtgtagagggaaatttatagcactaaatgcccacaagagaaagcaggaaagatccaaaattgacaccctaacatcacaattaaaagaactagaaaagcaagagc

SEQ ID NO: 25017 - DNA, 122 bp, Homo sapiens
  misc_feature 13, 99: n = A,T,C or G
aatcattggagcnaatatgtaacatactgtaaaagtccaaggagcaaaatttgcctgtccagctccctctccccaagaaacaacatgaatgagcaactncagagtgtcaaacaactgccatt

SEQ ID NO: 25018 - DNA, 351 bp, Homo sapiens
ctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgctcctgaactatgacacatgaatatgtgggctaagaaatagttcctcttgataaataaacaattaac

SEQ ID NO: 25019 - DNA, 461 bp, Homo sapiens
  misc_feature 3, 14, 35, 49, 51, 127: n = A,T,C or G
gcngaaagaagagngaatgcataagtgttacaacnggaacacccctggngngttcaagtaccattacaggacagccccactaagctagttcagagacaggccaggagagattaagaggaaatggggncaaagcagttaaagaagccagatcctgtagtgtaatgtaggcacaggcaggggcactgactttcactcgactaaaatgggatccactgggaagcttggagcagaaggggaacctgatctaacttcatttttaacagaactgctttagtgggctgtgttgaggatagatcatgcaggtccggatggagagcaggtggatctgttaaagagaccatagcattaacctgtgtgagagatcatgggacagagggaggggtgatggaaagtgatggatctgagtatattctgcagataggagcagacaagattttttgatgaactacaaatgccacagg

SEQ ID NO: 25020 - DNA, 300 bp, Homo sapiens
  misc_feature 14, 49: n = A,T,C or G
cgcgaacagatatntaaaacgattcgaaaagaagtgggaagatttgttnaagaacgagtgaaggattttaaaaccgttatcatcaagtacttagaatcactagttcaaacacaacaacagctgataaaatactgggaagcattcctacctgaagccaaagccattgcctagcaataagattgttgccgttaagaagaccttggatgttgctccagttatgctggattccacagtgaaatcatttaaaaccatctaaataaaccactatatattttatgaattacatgtggttttatatac

SEQ ID NO: 25021 - DNA, 195 bp, Homo sapiens
tcttatttctagttaaggattgtataagggcaaccttataatcatggagacaattcttttctcaagctaggaattgtcacttttatcaggcagagaggacaggaatgtgaaacatcctcatcatagatggctgacacctcattacagctgaggttaccaagcagcgagacaataaccctccatccatacccaatt

SEQ ID NO: 25022 - DNA, 188 bp, Homo sapiens
  misc_feature 3, 4, 30, 33, 37, 39, 41, 44, 46, 50, 180, 188: n = A,T,C or G
tanngagaaagggaacgagagcgggaaagnganaganananaangngagngagaacgagaacgggagcgagagagagagcgagagagggaactgggagcgagaaagagaaaaagacaaaaaacgggaccgagaagaagatgaagaagatgcatacggaacgaagaaaacttgaaagaaanctccaatn

SEQ ID NO: 25023 - DNA, 500 bp, Homo sapiens
  misc_feature 3, 4, 45: n = A,T,C or G
ganncatcttgcaatccactattatcagaaggccctggagctccnttcacttgtggtagagggtatagaacttgaccagttagacttacgaagagatattgcctacaacttgtctctcatctatcagagcagtgggaataccggaatggctcaaacgcttttgtatacctattgttctatataaagcaccgcaactgagaacagagcaatggcagctgctgtgtgaggaccagtgtcttctgtctcagggcttattatttgtaactccaaaatagaaatgacaatttcagaattacctaacaaacagtgtatttatttttaatatgtgataatgatcttgtggtatatatgcaaaattattcctacaaaaatttgtatattggtctgcattttcctttcacattctatagtgaattgttcccaatgttgaaatggcgtgtaagcctttgagctagcttgggagtcgaatcactattttcactcacaccatttatcatctt

SEQ ID NO: 25024 - DNA, 497 bp, Homo sapiens
  misc_feature 129, 165, 254, 395, 420, 438, 441: n = A,T,C or G
caccaggactgtgttgaagggcgtagggtttcttttaaatgtaatacctgctcatcttttcttcttgcacagtgtctgagaacatttacattatagataagtagtacatggtggataacttctactttnaggaggactactctcttctgacagtcctagactggncttctacactaagacaccatgaaggagtatgtgctcctattattcctggctttgtgctctgcaaacccttctttagcccttcacacatngcactgaagaatatgatgctgaaggatatggaagacacagatgatgatgatgatgatgatgatgatgatgatgatgatgatgatgaggacaactctctttttccaacaagagagccaagaagccatttttttccatttganctgttccaatgggccatttggatgncaggtgctattcacgagntgnacattggctcaagattaaggtttggacctcagtcccaaccaacattccatttgata

SEQ ID NO: 25025 - DNA, 498 bp, Homo sapiens
  misc_feature 26, 50: n = A,T,C or G
accaaaggaaagctattttgcgaacngtcttctccagcggagatggccantgtgctttgtaacagagccagactggtttcctatctcccaggattttgctctttagttaaaagggttgcaatcccaaagccttttcgactgcaggatcatcgggttcggatgagtctcatgtggctgctgcacctccagatatatgctctcgaacagtgtggcctgatgaaactatgggaccctttggacctcaagatcagaggttccagcttcctgggaacataggttttgattgcacctcaatgggactgcttcacagaagaaaagcctggtcataaaactttgcctgatgttctagcagaacctttatcaagtgaaagacatgagtttgtgatggcacaatatgtgaatgaattcaggggaatgatgccctgttgaacaagaaattaacagtgcagaaacttttgaaagtgccagagtagagtgtgcaaatacaaacatgtccag

SEQ ID NO: 25026 - DNA, 431 bp, Homo sapiens
tgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaacta

SEQ ID NO: 25027 - DNA, 497 bp, Homo sapiens
  misc_feature 77: n = A,T,C or G
caaaatcttgttaatgtcattgctaaaaaataaataaaagctatttactggaaacctaactgcaatgtggatgttgntacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagcttctgtaattcattgagcagttagctcatttgagataaagcaaatgccaaacactagctctgtattaatccccatcattactggtaaagcctcatttgaatgtgtgaattcaatacaggctatgtaaaatttttactaatgtcattatttggaaaaaataaatttaaaaatccattcaaaat

SEQ ID NO: 25028 - DNA, 500 bp, Homo sapiens
cagagcttcaacatgcatgaagcaaatagctgacaaaattgaaatgagaagtggacaaatccataattatagttggagatatcaccactcttggtaattgatagatcaaatagaaagaatgtcagtgaagatatagaagactttgacactcacaaccaatttgatctagttcacatttctagattgcttaacaacaacaaatatacacattattttcaaatacacattgaacatttggtaagatagaccatatttggggtgataaatcaagtctcaataaattttaaaatatttaaatcacatacagagtatactatgtgccacaacagaattaaattaaaactcagtaacattaagatcattggtaagccccaaatatttgaaaattaagcaacacatttctaaatacccgtgggctccaaagaagaaatcacagggtaatttgaaaacattgtgaattggctaaaaataaaaacacggcatttcataatttctggatg

SEQ ID NO: 25029 - DNA, 500 bp, Homo sapiens
  misc_feature 28, 29, 452, 465, 469: n = A,T,C or G
aaattatacttgtgtttaattttcagtnncacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcaggtatgacttcaggagaaatggtgtatttttacatattattgttagcctggtaaaagatgaaactaattgggaagttcattctaatcctgtcagggatgatttctttattatattcagttggaaaaatattagaaatactttgattaccaaagtaatcacagtttctcaatgatggccattgataattttaatgattttaagcttcagtactttaattcctactacacatacacacagctgtgatttagagacttgaatcacaggcatgggnggcttgagtttgnagtnctagctactcagggaggctgaggcaggagga

SEQ ID NO: 25030 - DNA, 356 bp, Homo sapiens
  misc_feature 9, 33, 35, 36, 37: n = A,T,C or G
ccttgcatnctgcccattattgaaaatgggatnannnttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgc

SEQ ID NO: 25031 - DNA, 456 bp, Homo sapiens
  misc_feature 29, 64, 65, 355, 371, 412: n = A,T,C or G
aacttcccgtgcttactgcaaacctggtnttgttgaaatgtttagaaaggctgaatttctgttnnactttgctcttctaactccagattaacatttccctctaacagaaatgctgtatcacaactaggacaggacaggacaggatctgttcctcctgtgtctaaccacactgctctgaccctgcctgcttctcctccttaagtgaagatcactgactgaaaaaaaacaggttgtagaaaagcatgtataatatgacctcattttactaaaaatacatatgcaggctcgtgcatggagagagatcaggattggtgagcaaagtggtgatctctgagtgcgggcatgcatagttggncattttcagtttttgnttatctgcattttcttcttctaacatgtgcataggttctgntataagttatttctctttaaggggagaggtgagatcaaaaaatc

SEQ ID NO: 25032 - DNA, 319 bp, Homo sapiens
  misc_feature 27, 28: n = A,T,C or G
tgagggaaattgacatcacgtcttaanngttttttatggggttgggccggatggctcacacctataattccagcactttcagaggccggggccgggtagatcatttgaggccaggagttcgagaccagcctggccatggtgaaaccccatctccactaaacatacaaaaattagccaggcatggcagcacatgcctgtaatcccagctactctggaggctgtaacacaagagtcacttaaacctgggaagtggagtttgcaatgagccaagatcacgtcacttcactccagcctgggcaacagagcgagactccatccc

SEQ ID NO: 25033 - DNA, 498 bp, Homo sapiens
  misc_feature 27, 28, 30, 35: n = A,T,C or G
ccagcacctcctctcttctccttttgnncnttctnacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgtttctttggaccaaagatctctttcgtgattccttgcaacaatcaatgagaatcttcatgtattctggagaacaccattcctgatttcccacaaactgcactacatcagtataaccgcatttctagtttctatataggc

SEQ ID NO: 25034 - DNA, 282 bp, Homo sapiens
  misc_feature 15, 19, 28, 30, 33, 35, 40, 41, 62, 80, 163, 170, 207, 212,237: n = A,T,C or G
tgctagcgtgaggantacnctggatgtnanttnanaggcnnagaagcgataatgggttcaanacaaagtgagatgtatgnattttacactcaagtgcacgcatagacaataacttatatagattaatatgtgtatttcaagcaaaggcagagaaatactaagnatttgtnatcttggtgtaatttaccctttcacacattttgcatngtctntaaataacaaaactaagcattaggnagacattgagtcaaagaaatttgaaccatacagagagtgaatttg

SEQ ID NO: 25035 - DNA, 259 bp, Homo sapiens
  misc_feature 30, 170, 174, 211, 227, 250: n = A,T,C or G
tcaagctaattttctttttctgaagcctgnaacaaatgatctagttcagaaggaagcaaaatcccttaatctatgtgcaccgttgggaccaatgccttaattaaagaatttaaaaaagttgtaatagagaatatttttggcattcctctaatgttgtgtgtttttttttngtgngtgctggagggaggggatttaattttaattttaaaangtttaggaaatttatncaaagaaactttttaataaagtntattgaagg

SEQ ID NO: 25036 - DNA, 209 bp, Homo sapiens
  misc_feature 2, 11: n = A,T,C or G
cngacgctacncggactaccccgatgcatacaccacatgaaatatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaag

SEQ ID NO: 25037 - DNA, 103 bp, Homo sapiens
  misc_feature 1, 82, 98: n = A,T,C or G
nctcagagtagtgccttgcacctagagtgcgtgcataatccatacaaggacggatgtaatgtatgtattatgaaaagtagcncacatgggcaccaggnggcta

SEQ ID NO: 25038 - DNA, 323 bp, Homo sapiens
  misc_feature 8, 246: n = A,T,C or G
gctatagnccaaaggcatttctgcttagaaatgtttgtaaggttgtttctttccccagtaactggattctaatgaggatagcaggtattagtgtctgctgaactgatggttgctcccggagatgtgttggtattccctatgtgttaccatgtgtgttttttaatcctttttttaactacttttgataaagaaataaggaaaagaatattttttttcactatttctattgttgatatttcaagaatngtgatattcttggagtttttcgtatggtaccttttctatattgttccaaatcagtggcattttcaggtatgttgagg

SEQ ID NO: 25039 - DNA, 500 bp, Homo sapiens
  misc_feature 19, 24, 37, 498: n = A,T,C or G
atgtacaatttacagaatnactancaaaaccaatcantttgacaccgaaaatacaaaaatttgattgacttcaaactgaactggaaacccattggagtagatatttagcctttttgtgtggcatggtagtctacaattctgtcagcatctgttttccatacaagactgtcacgcaaaggatcaatttgtgcatgtgccagggcacctcatggcttgctccctggccaaaaccacaggcaggcagggctggggtggacagtccagtcattcctgcaccttcacttccagtgaagcccacaattctgggagaaagtgaggccccagctcccctaactggagcccaagaattgctgaattagcagagaagatatttttggtgaccaggtttttttcagaactgtacaaatgttgagaaaaatgttttgtgtctttactaaaaggatgaataaaatcatccatcatcatcttgctttcccgcacaaaagatgatcactgggngg

SEQ ID NO: 25040 - DNA, 189 bp, Homo sapiens
  misc_feature 29: n = A,T,C or G
acactgaagctggagctgttaaatttatnttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatgt

SEQ ID NO: 25041 - DNA, 493 bp, Homo sapiens
  misc_feature 381, 447, 466, 467: n = A,T,C or G
gcattttgaaactctgcattcatggtgctttgttaggattccctctgcaatataggatcacagtacatgattactatggttattttcaaaaagtcaacagttccttcagattgcttggaagcagttgtgaacaattaagagaagtggatatgaccctgtaatgtatttcccgtatagaaagaagcagagggtatctgtagttcaagtgtgtttccaccaattaaactgtaattgtactctttccttacatgtttaatcttagggactaatatgcaaacaacaatgttctcacacaaaacaaattaaactcaacttactttcaatacaattaaccaataacaatttttttcataaatacatgggatttcaactttatattgnaagtcattctgaatagaagtccatgtcaggaaattagtatgttaattatcaacttagaaactctgngctggaatgatccctgggnngaatgatggttacacaccctattatt

SEQ ID NO: 25042 - DNA, 466 bp, Homo sapiens
  misc_feature 27, 122, 190, 214, 238: n = A,T,C or G
tacatcccatatgcaagggatgcagtnattaaatgctgttcttctctcctaagttgaaaatcagaaacttgtggaaaagagcacttgaatgttggtactctatgtttggtgaagattgcttntccccataaaacactccaggaacaactgacgtgacagttgaagaccgttttgtactaagtctcatttngtatactggtaaaaactacatgcntgattaaaccattaaatgcttgtnactttaaattcattatgtgtcattaatatacttttccaaagataagatttttaatcactgccagttgtaaattatttttagccaatttttaaatcttttcaaagcagctttgaaatgtgaatatttaaaggtagacctgtgccgcaagataattaaacttttttgcttttaaaaaatgtctgcatttttaagatttttttactttaaacgtgaacttattttaagcta

SEQ ID NO: 25043 - DNA, 441 bp, Homo sapiens
  misc_feature 6, 21, 28, 31, 51, 53, 419: n = A,T,C or G
ctgcantcccgacaaatgcangattatnatnttgatcattccaaaccaacngntgaaacggtagcacccgacaacactgcaatccccagtttaagggctgaagatgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtgacttaagtgtgaatttggagtatgcaccaactgaaggtcattggacataaaagaagatatgagtgagcctcaggagaaaaaactctcagagaacactgattttttggctcctggtgttagttccttcacagattctaaccaacangaaagtatcacaaagagagagg

SEQ ID NO: 25044 - DNA, 492 bp, Homo sapiens
  misc_feature 7, 15, 46, 173, 209, 225, 244, 247, 274, 320, 347, 349: n = A,T,C or G
agagaantgactggntataatattaatacctgtgtgcataaatcantattgtatcttgctgataaatctcacaacagttaattattttattccccatttcatacttagctctattttaggcaagttcacaaatatcattgaatgagttcattcaatgtcatcatgatgatatngaaatgtcaatagcagatgacttgtttctggggtgntaatatgcctgttggntacatttgtgttttttggnggnggaaggcagcactgaggcaaacagcangaatacagctaaagcctctaactgcatactcttctcactcgtgctnaaaactgaagcgtggataattgggggngnattccctaaaaaggtatggcatgatgcagtagagaaataaggtaactttcctatccctgtatcaaagttctttggaaggaactgagacagcccaaataagggcagaggttctggggaatcatgaaatctttctaaacaattgg

SEQ ID NO: 25045 - DNA, 282 bp, Homo sapiens
  misc_feature 12, 31, 33, 34, 52: n = A,T,C or G
cccgcctagacntcccaaagtgctgggagtncnngcgtgagccagcgcgccnggcccccaccagggggttaattctcttagtaaaaaggccagttcagagaggggccctgtcttgtccccatccaggggagaagatctacagagcaccctgggaatgtccaagcccagtacgtattttatttcaaacttcaaaatactgccctcttctctctagtattatgaggtttgatgaacaaacctataagttagttatactttcccctttctcctaaattttcatct

SEQ ID NO: 25046 - DNA, 480 bp, Homo sapiens
  misc_feature 33, 41, 73: n = A,T,C or G
cataagtaagttcacttatagtatttctataanttgattcnttgccgtaatagagccatgtaggaaatgcacngattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgctttggcagtgagtaaatagcatattttgaagtagagttgtatactttttcataagatgtttgggaatttttttcctgagtaataatttatccacatctacatcagtgaaagctatctacctatcctgagctatcttaaagg

SEQ ID NO: 25047 - DNA, 261 bp, Homo sapiens
  misc_feature 9, 27, 28, 32, 36, 49, 58, 69, 94, 114, 120, 164, 192: n = A,T,C or G
ccagagagngcaccctctaaatcaccnngatnaaangggacaagcatcnagcacgcancaatgcagctnaaaacgcttagcctagccacacccncacgggaaacagcagtgatnaacctntagcaataaacgaaagtttaactaagctatactaaccccagggntggtcaatttcgtgccagccaccgcggncacacgattaacccaagtcaatagaagccggcgtaaagagtgttttagatcaccccctccccaataaag

SEQ ID NO: 25048 - DNA, 454 bp, Homo sapiens
  misc_feature 45, 48, 79, 418, 452: n = A,T,C or G
gccagctgctggaggtgccgagaatctgagtttcggcaagcagcnttntctggaaactaatattttaaaaatgactacnccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaactcggaagtgaagaatcaagtgagantggaggaggtgaagctcttatcactaaaaaaatntc

SEQ ID NO: 25049 - DNA, 351 bp, Homo sapiens
  misc_feature 8, 22, 27, 45, 76, 80, 88, 215: n = A,T,C or G
aaaaaatntgtgaaggtggaantttgnttttagtatcgtattttncctcttcactatccaataaaaataagtgagnttancaaccctncaggatggcccagaaaagtgagagaatgataaatttaaacaaacagaatgttaacccacctaagtgaaactattagaggaaacagcttcaacaacaacaaaaatgggcacttaagaaaattcaagtncagcataaaaatacttttctgagcttaaaactcagttgatgaagtgggggatagtcactgtggagacttaaattattcaactggagacttcaattattagactggaaaaataagataaatctccaaaacatagagc

SEQ ID NO: 25050 - DNA, 283 bp, Homo sapiens
  misc_feature 29, 36: n = A,T,C or G
tacacaatggaattatattctaccatatnttttatnaaaatgaaattctggcatttgcagccacatggatagaattgagatcattatgttaaatgaaataagccaggcctagaaagacaaatatcacatgttcttactgatgtgggaactaaaaaaagttcgtctttagccaggagtcgtgatgcacccctgtagtctcagctacatgggaggctgaggcaggaggattgcttgagtccaggagattgattccagtctgggcaacatagcaagatgtcatgtc

SEQ ID NO: 25051 - DNA, 104 bp, Homo sapiens
  misc_feature 22, 43, 54: n = A,T,C or G
attgtgactgccaaaatatttngtcatcgagatattaattatnttcaagtggcngactccatacaagaaaataataaaagtatcagaagttaactgtgattatc

SEQ ID NO: 25052 - DNA, 203 bp, Homo sapiens
  misc_feature 4, 9, 15, 17, 19, 20, 22, 25, 33, 66, 96, 113, 114, 199, 201: n = A,T,C or G
gatnacatncaaggntnannanacntgagcganaaccaatctaaattggattctttaatgttgttnaccataacacaaaaagcatgaacttgtatnaatcctatataataganngatcatgcaccatatccacaggaggttggaaaaaccatgccattttctggaatttaagggtgttgcattatttcatcaatcattngntg

SEQ ID NO: 25053 - DNA, 499 bp, Homo sapiens
  misc_feature 33, 445: n = A,T,C or G
atcaatgcctgattctaggtgcatgcgggtganagaacaaaatgggtctgagacacctgttgttgttaagaaaataaggaagtctcaactaatgattgagacatgccaaagaacataggagctaactagaagtggctctcagtgacccaaactgagataaattgaacaagggaataaataatgatggcaatagattattcagattaattaaaccaaatacacacgaatccacactaatataaataaataattggataaataagaaaagtgggacaaaggaaagcttttccatacagtagaattctaatcaataaatatagaaagaatagtggaaatagattctcatttcttggcaaataccacataattgttgcagacaagtctgctaaaattagtggatacaattatgagaaacaaggatatttacataatctccaagtatctntcaacaaaatactgattttaaaaatggtaactttgaagtggagaaatgtggcag

SEQ ID NO: 25054 - DNA, 499 bp, Homo sapiens
  misc_feature 6, 32, 37: n = A,T,C or G
tgccangaaacccttaagaaaaagcgaaggantttcncagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacaagataacgctttgattgctcgatctctt

SEQ ID NO: 25055 - DNA, 494 bp, Homo sapiens
gacagccaggggagggaagggcctctagggaactttgctttttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgctttacaaagataataacagttgtgttctttgctctcgttttggatgcatagactgaaaaattaaaacaaataacttgtaaaatggcttgtaaaaaatacaatt

SEQ ID NO: 25056 - DNA, 473 bp, Homo sapiens
  misc_feature 26, 27, 28, 30, 185, 418: n = A,T,C or G
ggagtcaaacactggatgcagaaatnnngnatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgtngtatgtcagtgtaacatgcagatgtatattgcagtttttgaaagtgatcattactgtggaatgctaaaaatacattaatttctaaaacctgtgatgccctaagaagcattaagaatgaaggtgttggactaatagaaactaagtacagaaaatttcagttttaaggtggttgtagctgatgagtattacctcatagagactataatattctatttgggataatattattggangttgctggtcttcaaacatttaaatcaagcctttggactaaattatgctaatttg

SEQ ID NO: 25057 - DNA, 311 bp, Homo sapiens
  misc_feature 26, 74: n = A,T,C or G
gaaaggttaaaatatcaatgtttggnatttcaaattaaatctatttagtatgttattactggtaataaatgagnaacattataaaatataagggttttaaaaccatgaactcttccagcctgccacctaattggtaatgagttacaacacaatttgtgaatactgtgggccttttcaaaacagaatattttaggactgggcacagtggctcatgcctgtaatcccaacagtttgggaggctgaggcaggaggattgcttgagcccaggagttcgagaccagcctggacaacatagtgagacccctatttcc

SEQ ID NO: 25058 - DNA, 420 bp, Homo sapiens
  misc_feature 1, 8, 25, 45, 54, 74, 89, 95, 96, 104, 108, 115, 180, 234,266, 408, 411: n = A,T,C or G
nttaaaanaacaaatgcggaggagncttactgcttgattgaaagncacactatnaagctatagtaatataaggnggcattgaggaatantatacnncctttacnaaancatttgnaacagggacgtggtgtctaaacatagttccacacatatatagccagctagtattctacaatggtngattttcaatggtgaaagaacagactttttacaaatgatgcttgattaacttgntgatcaaatgaaaaaagatgagtcttgatctncacctttcttgttatagaaaatattaagttgaaatagatcagagacctggatgtaacatgtaaaactctagaactctagaagaaaatatttgagaaaatctttatgaacatgggttagggaaaagatttcttagataaaggngangaaaaatgg

SEQ ID NO: 25059 - DNA, 500 bp, Homo sapiens
  misc_feature 4, 5, 45, 384, 409: n = A,T,C or G
ctgnntccacatttacaaattgtgtacttaaatgaacctcatttnttttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtcatttcaacatataataagcaaaaaaattactaatcagctaataaaaacantcttgtctattcctaaatgtaattngggggggctaagcactttgtgtagtaaaatgatatgtgtctgctctatcattagacatttaaaagtttcatgtcttcacgtgaataatcac

SEQ ID NO: 25060 - DNA, 493 bp, Homo sapiens
  misc_feature 24, 465, 479, 492: n = A,T,C or G
caacaaaatattttgagacatgcnaagaaacagaaaagtgtgacctatatacaggaagaaaacaaaagtaactgcccgtgagagggtccaaatgttggagctagcaggcaaagacttcaaagcaacaattataaatgtgttcaaagaactacatgaaactttctaaacaattaaaggaaggcatgatgacagcatctcatcaagtagagaatatcagtgaagagaaattgttagaaaagaattataaaaatgaaaattttgagttgaaaagtataataactggaatgaaaaattgactagaggggttcaagagtagattttaatctgacagaagaaaaatattggcagatttgaaggtaggtcaataaagattgtgtatgctgaagagcagagaaaagagagtgaaaataaataaacagagctcctaagaaatgtgagataccatcaagcacacctacatatgcntactgggacaggtnaaaggaggagggng

SEQ ID NO: 25061 - DNA, 291 bp, Homo sapiens
taattcaggaacacagaaccaaatactgcatttttttaaataagtgagaactaaacattgagcatatgtggacacagaaaaggaaacaggagacatggaggccttcttggggtggagggtaagaggagggtgaggactgaaaaactacctgttggatactatgctcattacctggatgacaaaataatttgtacaccaaactccagtgacacacaatttacccatgtaacaaacctgcacatgtaccccaccaaacccaaaatgaaagttggaaggaaaaaaaacactgcg

SEQ ID NO: 25062 - DNA, 498 bp, Homo sapiens
  misc_feature 2, 42, 43, 73, 76, 441, 488: n = A,T,C or G
cngacagcattcgggccgagatgtctcgctccgtggccttanntttgctcgcgctactctctctttctggccnggnggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgctgnctgctttttaatattgatatggcttatacacttacactttatgcacnaaaatgtagg

SEQ ID NO: 25063 - DNA, 442 bp, Homo sapiens
  misc_feature 5, 27, 31, 376, 396, 401: n = A,T,C or G
acttntacctataaaaaccacttttanggcngtttgactgcattgagcggctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactaagacatttgtactaaggtatttcaagttatgtaaactcagcctgggcactttctggataactgtaaaatgttttataagatcatgattattgaagatcattttggaaaattttaaatgtcggtgagcagcttaactacttttgnatctagccttttttaacccncctgntacatttacttttttaaataaagaaattccagaagaaatgc

SEQ ID NO: 25064 - DNA, 288 bp, Homo sapiens
  misc_feature 12, 29, 53, 54, 55, 56: n = A,T,C or G
tacaagccagangagagtgggggccaatnggttaacattcttaaagaaaagannnntcaacccagaatttcatatccagccaaactaagcgtcataagtgaaggagaaataaaatagtttacagacaagcaaatgctgagagatttttgtcaccaccaggcctgccttacaagagctcctgaaggaagcactaaacatggaaaggaacaaccggtatcagctgctgcaaaatcatgccaaaatgtaaagaccatcgagactaggaagaaactgcatcaactaacgagc

SEQ ID NO: 25065 - DNA, 500 bp, Homo sapiens
  misc_feature 22, 47, 58, 77, 79: n = A,T,C or G
gacggaacaaaatcagctgagntgatgcagctagcctgaaaggtttnaataatttggntaagttgggattgagtggncnacagcatctctgctgttgacaatggctctctggccaacacgcctcatctgagggagcttcacttggacaacaacaagcctaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctgcaaaatcttgttaatgtcattgctaaaaaataaataaaagctagatactggaaacctaactgcaatgtggatg

SEQ ID NO: 25066 - DNA, 497 bp, Homo sapiens
  misc_feature 28, 30, 36, 50, 52, 290, 444: n = A,T,C or G
ccgcagataaggttttttctctttgaangntttagnttaatacaactacntnaaaaatatagtcaataggttactaagatattgcttagccgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggctacagagccccgaattaataccaatangaagggcaatgcttttagattaaaatgaaggtgacttaaacagcttaaagtttaagtttaaaagttgtaggtgattaaaataatttgaagggcgatcttttaaaaagagattaaaccgaaggtgattaaaagaccttggaaatccatgacgcangggaggaattgcggcatttaaagcctagttaaccgcattactaaacgcagacg

SEQ ID NO: 25067 - DNA, 426 bp, Homo sapiens
  misc_feature 11, 14, 37, 39, 52, 56, 68, 71, 86, 92, 93, 116, 134, 146,150, 179, 203, 210, 238, 256, 288, 291, 348, 360, 376, 425: n = A,T,C or G
gctgatgattntanagagagaatatgagccctcagangngtcgcacgaggangganaagataaaaggnctnaaaaacatgacgggngttganntgacgcttcttcatggagcaggnaaacgtgatctaaaaganaattgtgggatnggcncagcccccgaatcactccaatagaagggnatgcttttagattaaaatgaaggngacttanacagcttaaagtttagtttaaaaggtgnagggtgattaaaataatntgaaggcgatctttaaaaagagattaaaccgnggngattaaaagaccttgaaatccatgacgcagggagaattgcgttatttaaaggctagntaacgcatttantaaacgcagacgaaancgggaaagaataattggggaggggaagacggaaacaatttggagaagana

SEQ ID NO: 25068 - DNA, 500 bp, Homo sapiens
  misc_feature 29, 439, 452, 487: n = A,T,C or G
gcgctactctctctttctggcctggaggntatccagcgtactccaaagattcagggttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaagtgggatcgagacatgtaagcagcatcatggaggtttgaagatgccgcatttggattggatgaattccaaattctgctgcttgctttttaatattggatatgcttatacacttacactttatgccaaantcgcgcggttccnataatggtaacatggacatgatcttttccccaatnctactttgagggc

SEQ ID NO: 25069 - DNA, 249 bp, Homo sapiens
actcctagaagaaccaaatacctcaatttttgtttttgagtactgtactatcctgtaaatatatcttaagcaggcttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattg

SEQ ID NO: 25070 - DNA, 176 bp, Homo sapiens
  misc_feature 5, 32, 40, 60, 62, 76, 107, 155: n = A,T,C or G
tgttnaggatcaaattataatattgaaataanaacagctnacatttatatagcatgtttncntatctcaactaatnataaatgggaaaatgggcaactgggcaggcngaacccagagggaagcctgccctcattagaccaagacagcaaggtttnccctggtcactagatgaaatt

SEQ ID NO: 25071 - DNA, 154 bp, Homo sapiens
  misc_feature 2, 50: n = A,T,C or G
gngacatattgtccaaactagaaagctggtgaaatttcactgggcacagnggcttatgcctgtaatcccagcactttaggaggccgagacaggtgaattgcctgagctcaggagttcgagaccagcctgggcaacatggtgaaacctcatctct

SEQ ID NO: 25072 - DNA, 342 bp, Homo sapiens
  misc_feature 32: n = A,T,C or G
caggcctgccctaaaagagctcctgaaggatnctcttaacatggaaaggaacaaccggtaccagctgctgcaaaatcgtgccaaaatgtaaagaccatcgagactaggaagaaactgcatcaactaatgagcaaaatcaccagctaacatcataatgacaggatcaaattcacacataacaatattaactttaaatgtaaatggactaaattctccaattaaaagacatagactggcaaattggataaagagtcaggacccatcagtgtgctgtattcaggaaacccatctcacatgcagagacacacataggctcaaaataaaaggatggaggaagatcta

SEQ ID NO: 25073 - DNA, 498 bp, Homo sapiens
  misc_feature 5, 9, 30, 394, 418: n = A,T,C or G
agganggtncttgttagaaccatgtgacgntgtcacagcccaagatagttaagtgggatccgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggcagattttgaactcttcaatctcttgcactcaaagcttgntaagataggtaagcgtgcataagntaacttccaatttacatactctgcttagaatttgggggaaaatttagaaatataatttgacaggattattgggaaatttg

SEQ ID NO: 25074 - DNA, 496 bp, Homo sapiens
  misc_feature 27, 218, 410: n = A,T,C or G
acactaaatgcttcaaagataagaaanttcatcctaatgatttctaaagagcagttaaaagcattaaaataagtaggtaggctgttaagattaaaattaacattttggggacagaattgtgtctgtaaaaatgtcattggttttattacaagcggattattttattcatattttaaaacaaatgtttaagccacattgatttatcctcattgaggatnatggtctgtgaccacagtaatatccacttatataaatgccaaataatcagagagcttataaagtacaattgtttttgcatcattttctgaatttctttctcttcttttgggtttgtcctctcattgaagtccagtggtttggaaattagttttggcacattgtcttaatgtacctgaaaattgctctgctgnattttgcagcgttcttcatttaattataatgggccatattagacacatttggaaagagaagtccaggacacatttaggggccatgg

SEQ ID NO: 25075 - DNA, 500 bp, Homo sapiens
  misc_feature 9, 14, 53, 499: n = A,T,C or G
ctctggganagatngagattaatacaactacttaaaaaatatagtcaataggntactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggaggaattgcgtcattcaagcctagttacgcatttactaaacgcagaacgaaaatggaaaggattaattggggagng

SEQ ID NO: 25076 - DNA, 299 bp, Homo sapiens
  misc_feature 6, 40, 47, 107, 266: n = A,T,C or G
tcaaanctggagaagatcttagaggttgaagcccaccttntcttttnacataggagggaacagaccatggaaatttaaacgacttcctcacggtcacagaactagtnttttaatcctcaggcagtgcatccccccaccctacaactgagcacaacctctttccccacagtgcaattcagaatatgctcagggaatgccagccaccttgtaaaactgctggggagaaaagcatgattcccacaaggactaagtatcaggggatttgnaattttcctgttttgtattatctgctttgctga

SEQ ID NO: 25077 - DNA, 413 bp, Homo sapiens
  misc_feature 3, 18, 32, 42, 51, 53, 54, 56, 62, 64, 66, 68, 70: n = A,T,C or G
gtnactggaatgtctgancttcaacaaatttnacaaaaacantgatgtggncnncnaacatntntnananagcccaacatcactgatagagaaatgcaaatcaaacccacaatgagataccatctcatgccagtcagaatggcaattattaaaaagtcaagaaacaatagatgctggtgaggctgtggagaaataggaatgcgtttacactgttggtgggaatgtaaattagttcaagcattgtggaagatattacggtgattcctcaaggatctagaaccagaaataacattttgacctagcaatcccatcactgggtacgtacccaaaggaatataaatcattctactataaagacacatgcacacacatgtttatcgcagcactatttataatagcaaagtcatagaacc

SEQ ID NO: 25078 - DNA, 302 bp, Homo sapiens
  misc_feature 11, 19, 29, 30, 32, 39, 55, 56: n = A,T,C or G
aacctgagaantttccttntggggagggnntnttggagngaacccttctaagcanntgtcagaaaaccatgggacttaatcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttatttttttttt

SEQ ID NO: 25079 - DNA, 487 bp, Homo sapiens
  misc_feature 12, 15, 43, 66: n = A,T,C or G
taagttacaacnttntgagagctgagaattttccttttggggnggggctggaggggggatgctttnctaagtctctgtcaaaaaggtcttcttttaattagaactttatctctgtttctcactgtaaatggctgtgaatgacttcccccgctattcctataaacatctgccacgcatatgaagtcagctttccaagtggtatcttgatatcttgcaatgtttctggctagcactgagaatcatcttatactggctccatgccaatgggagacctactttagcttaatttactggtaattaactccacaggactgattcacttttaatttcaaggtagtaatgatgtgctgaaaatggcttaccagggcactaagctgtgagtgttgggagttgttggatttacaaattaacagagatcatgttttatttaaatgaaaccgcgtattatccactcaggaataaaaaaaatcctaattgctgtgggggg

SEQ ID NO: 25080 - DNA, 170 bp, Homo sapiens
  misc_feature 31, 101: n = A,T,C or G
gcacctgcagaggcaggcttcagagctggancagccatcaatgccaggctgccctttaacttcttcttcccgtttgtttgacaatgctcagatgcatcagntccttaatatacacgtgaaatttgaaaactgtacattcggtgagattaaattttatatacaactagcgg

SEQ ID NO: 25081 - DNA, 495 bp, Homo sapiens
  misc_feature 13, 26, 30, 52, 54, 55, 77: n = A,T,C or G
gctataagtaatnctcaagaaagccntcanttttataacctggcaaaatctngnnaatgtcattgctaaaaaataantaaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaaatccccatcattactggtaaagcctcatttgaatgtgtgaattcaatacaggctatgtaaaattttta

SEQ ID NO: 25082 - DNA, 304 bp, Homo sapiens
  misc_feature 2, 42, 50, 54, 82, 84, 86, 172: n = A,T,C or G
gntaaaagaatgtcgtgtttcataatgacttttaacttgggnaaaaaatntttnttgcacgaaagtaccttgaatgtatggntnangctggaaatttcggaagtattttgggggtgttctttgtctaaaaataagtctggtttttgtcaagtccttcagaatattatttatnccggaagaattggtcctcttgcacttggcaggtttattttccggggatacattgttggggggagaaggggtttcttgccactctttccagattgaggtctggtgctggttaaggagggactacccatcctgc

SEQ ID NO: 25083 - DNA, 500 bp, Homo sapiens
  misc_feature 49, 370, 495: n = A,T,C or G
aagctgacagcattcgggcccgagatgtctcgctccgtggccttagctntgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggctttctatctcttgtactacactgaattcacccccactgaaaaagatgagtatgcctgccgtgtgaaccatgtgactttgtcacaacccaagatagttaagtgggntcgagacatgtaagcagcatcatggaggtttgaagatgccgcatttggattggatgaatttcaaattctgcttgcttgcttttaatattgatatgcttatacacttacactttatgcacaaaatngtagg

SEQ ID NO: 25084 - DNA, 496 bp, Homo sapiens
  misc_feature 35, 52, 492: n = A,T,C or G
ccgcagataagtttttttctctttgaaagataganattaatacaactacttnaaaaatatagtcaatagggttactaagatattgcttagccgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatctttttaaaaagagattaaccggaaggtgattaaaagaccttgaaatccatgacgcaagggagaattgcgcatttaaagccctagttaacgcatttactaaaccgcngacg

SEQ ID NO: 25085 - DNA, 498 bp, Homo sapiens
  misc_feature 7, 17, 51, 391, 490: n = A,T,C or G
gctgctncgagctgagnttgtgccactgtactgcagcctgggtgacaggantgagactgcatctcaaaaaataataatgaaactttccaaaacaaagtgccaggaccagctgggttcactgatgtgtttttgagatacttaaggtagaaatgataccaagtctctaccatctctttcagaaaataaaagcagagataacacttcccaactcattttgtgaggccagtattactctaatagcaaaaccaggcaaagatattacaagaaaggaaaactacagatcaatatttccattgaacacagatgcagaaatcctcaaaatattagcaaatcaggaatgcaaggcttgttcaacatttgatattcaagtgtaatccattgcatgcattancagctcaaagatgaaatacgatcatatcaataggtcagaaaaagcatttgacaaaatccaatatccattcatggttaaaacctctcaacacagaaggantacaggag

SEQ ID NO: 25086 - DNA, 497 bp, Homo sapiens
  misc_feature 6, 206, 288, 317: n = A,T,C or G
aaaggnttctggggagccgcagcttccaaacgtataaattattgcctttgtccaagttaaatgtctgggtaggaaatggcattgtcaccgtagtggtgaaaaagatttagtgccttgaaaaaaatcatgcatgtaagccagtctctgagccggattctcgtcatcacctctctgaaagcttctgatgctcatctatatggatgcangagatgcagatactacaggtgaaaagattaagtcactgaggagttgcgggaattgatcattgtagctcactataaatattgnattatcattatcctcatttcctttatgtngttatttcacaccacttactatacattagcattgtgacagtgatcaagtgtgagcctccgtgtgtctttagtccacgttgcttgcacaggcctagcaccttactcctgtggaaccagaggtcccagctggcaatcactcacatgggataaacagcagagcattttgctgcctaggcaaac

SEQ ID NO: 25087 - DNA, 286 bp, Homo sapiens
  misc_feature 7, 56: n = A,T,C or G
taaaganccataaagatgaagttcacccagaggtgaagtgtgttggctccgtagcnctgactgccttggtgactgtatcctcagaagaatttgaagacaagtggttcagaaagatcgaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgtttt

SEQ ID NO: 25088 - DNA, 276 bp, Homo sapiens
  misc_feature 2, 15, 49: n = A,T,C or G
cngccagcgcagggncttctgctgagggggcaggccggagcttgaggtnccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagc

SEQ ID NO: 25089 - DNA, 500 bp, Homo sapiens
  misc_feature 12, 14, 39, 41, 497: n = A,T,C or G
gcggcttccttntnaccttgaagaataatcctagaaatntnacaaaatgtgatgcttttgtaggtacctggaaacttgtctccagtgaaaactttgatgattatatgaaagaagtaggagtgggctttgccaccaggaaagtggctggcatgccaaacctaacatgatcatcagtgtgaatggggatgtgatcaccattaaatctgaaagtacctttaaaaatactgagatttccttcatactgggccaggaatttggacgaagtcctgcagatgacaggaaagtcaagagcaccataaccttagatgggggtgcctggtacatgtgcagaaatgggatggaaaaatcaaccccataaagagaaaccgagaggatgataaactggtggtggaatgccgtcatgaaagggcgtcactttcacgagagtttatgagagagcattaagccaagggacgttggccttggactgaagtcgcattgaactctaaacactctgnggg

SEQ ID NO: 25090 - DNA, 464 bp, Homo sapiens
  misc_feature 44, 47, 48, 78: n = A,T,C or G
ctggcgctgtgacaactgccgcagacctgggggtgaacccagtnttnnaaggcactactggccagtcctacaaccagnattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcaggacccagcttagagttcttctttctttcttaagccctttgctctggaggaagttctccagcttcaagctcaactcacagcttctccaagcatcaccctgggagtttcctgagggttttctcataaatgagggctgcacattgcctgttctgcttcgaagtattcaataccgctcagtattttaaatgaagtgattctaagatttggttg

SEQ ID NO: 25091 - DNA, 498 bp, Homo sapiens
  misc_feature 1, 3, 36, 37, 480, 482: n = A,T,C or G
nancacaaggagatccgacggccgtcttaaggagtnnagggaacaattaaaagaacttaccaagcagtatgaaaagtctgaaaatgatctgaaggccctacagagtgttgggcagatcgtgggtgaagtgcttaaacagttaactgaagaaaagttcattgttaaagctaccaatggaccaagatatgttgtgggttgtcgcgacagcttgcaaaagtaagctgaagccaggaacaagagttgctttggatatgactacactaactatcatgagatatttgccgagagaggtggatccactggtttataacatgtctcatgagggccctgggaatgtttcttattctgagattggaggctatcagaacagatccggggaattaagagaggtgataagaattacctcttacaaacccagagttatttcagccgtgtaggaataatacctccaaaaggctgttggtatatggccaccaggtncngggaaaaacactcttg

SEQ ID NO: 25092 - DNA, 493 bp, Homo sapiens
  misc_feature 11, 40: n = A,T,C or G
tcagcctgtantaaaagtcctagtagtaaatatgttcatncttgggggctagtagtaaatatgttcagccttgggggctattttgttaactgctctttgagctctggcctggtagtgggaaagcagccacaggcaatacataatcgaatgggtgtggctgcttgtctttaataaagacaagcagagggccatagttgcagaccccagatttagaccatgaataagccctttgactctcttttagatagtaggtagattttcctttcatacctctactcccaggagtttgaattaattttcacatgaattgctcactatgatgattggttgccagacattcgcagtttccaccagaaatgtttttccttatgttgccagttcttccttggatgctgagtgagcatcttcattcattgtgcttgaacacaatgagtgggtcaggtatcagtagtttggtgcactttatatagtttggatttattaactgtttgag

SEQ ID NO: 25093 - DNA, 336 bp, Homo sapiens
  misc_feature 4, 8, 30, 63, 207, 225, 257, 267, 297: n = A,T,C or G
caanatgnagaaacctcatctctactaaantttcaaaattagccgggcttggtggcgcatgcntgtaatcctagctactcaggaggctgaggcaggagaatcgcttgaactcgggaggcagaggttgccatgagccgaggtggcaccactgcactccagtctggacaacaagagcaaaactccatctcaaaaaaaaaaagccgccgnggtagctcacatttgtantcccagttctcaggcagctgaggcagggagantcggcttgancctaggaggcagaggttgcagtgagccganattgcgctactgcactccagcctgagcggcagagcaaga

SEQ ID NO: 25094 - DNA, 338 bp, Homo sapiens
  misc_feature 1, 11, 58: n = A,T,C or G
ntatttcaccncttacactgaaataaattgcagattgaacaaagattcaaacataaanttttaagctataaatacatagaaggaagcaagggtgaataaatttatacacttgcagtggaaagtctttgtaatcaggacacaaacccagaatcacaaaagagaaaaatgacaaatttaactacataaaattaataacttgtgcttggaaaaataattcataaattaagtttaaaaaagagacaaagttagaaaacagtatttacaacaccaatgtcagacacatggctaatttcattcattaacaaagagcttataagaatcaataaagaaagataaac

SEQ ID NO: 25095 - DNA, 498 bp, Homo sapiens
  misc_feature 8: n = A,T,C or G
ataagtgnccttttgggctttccctcttttttgtaaagcaatgtctgcctagtttattgtccagttaactttagtgaccttttaaaagttggcattgtaaataaaacaacttgcaaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagtttaaatatatgcctagagactcaagtactacccagtttgtggtttttgggagaaatgtaactggacagttagcttttcaattaaaaagaccttaacccatgtgggatgcatcttttataattaggggtcccatgtggagaaaattattcacactactt

SEQ ID NO: 25096 - DNA, 403 bp, Homo sapiens
  misc_feature 1, 57, 287, 305, 321, 397: n = A,T,C or G
naactaaaccagccgaaccttgtttgaggtatgaaagcagctgttataataaactcntttgctctacctcttttcctgttatggtggaatgggctggtttaaagtaaatgtctccaatccatggattttctggggtcatgaaacattgtttaattggcagactggtattacattttttggggaagttaggaagtaacaggaatgccacacgcccatggttagaatccatgcagtgtaaaaggtctgtaaaggaaaccggtccctgggaattctggagcccattattncccactttccaacccccnggggtgggcccagccntctcaaggttttgaggttgttccaaaaaagaatgggatttctgcctctcttttatcccaggactttcaaaggagancaaggg

SEQ ID NO: 25097 - DNA, 500 bp, Homo sapiens
  misc_feature 2, 3, 57, 59: n = A,T,C or G
gnnaattgcccagccagcgcaggggcttctgctgagggggcaggcggagcttgaggntnccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaaggcaatgcttttagattaaaatgaaggtgacttaaacagcttaaagtttagtttaaaagttgtagggtgattaaaataatttgaaggcgatcttttaaaaagagattaaaccggaaggtgattaaaagaccttgaaatccatgacgcag

SEQ ID NO: 25098 - DNA, 498 bp, Homo sapiens
  misc_feature 2, 439: n = A,T,C or G
anacgagaccactgcaaaatattttccttttatactacagaaatgagaatattcacattaaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagtctacacattacattgaagttaaacacaaaattatcagtgttttagagacatgagtccggctgtgtaagtaaaagtcaaacattatttccaccataaagtatgtattgaaatcaagttgtctctgtgacagaatcatacttattcccatttttaagcatttgcttctggtttccctacctagaatgtcagatggttttcagttatctcccattgncaaagttgacctcaagatacatttttcattaagcatctgagatctaagacacaattatt

SEQ ID NO: 25099 - DNA, 498 bp, Homo sapiens
  misc_feature 17, 36, 58: n = A,T,C or G
aaaggcacctgtaaggntcgtctaaaagctgatggntatgtaagttgctcaggcactnagatgacagcagattctgggttctgggagtgttctgtgtctcttacatgccctggaggcctcacggtctcagtgctgaggcggcacacctgtagcacacctgcgtaatgtgcggctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgacatatttatttacttttctaactgctccaacagccaaatgccttttttatgaccattgtatcagttcattaccaaagaaatgtttgcactttgtaatgatgcctttcaagtcaaataaatgggtc

SEQ ID NO: 25100 - DNA, 293 bp, Homo sapiens
  misc_feature 4, 5, 58, 59: n = A,T,C or G
gaannaatcctatcaacagataactttcataaaaaggaatacaggaaagaaagaaagnnggaagagaagaccacaaaataaccagaaaacaaataacaaaatggcaggagcaagtccttacttatcaataataacattgaaagtaaatggactaaacttttcaatcaaaagacacagagtggctgaataaatcaaaaagcaagacccattgatctgttgcctacaagaaacatacttcacctataaaaacacacacagactgaaaataaagaaatggaaaaagatatttcaca

SEQ ID NO: 25101 - DNA, 197 bp, Homo sapiens
  misc_feature 17, 50, 196: n = A,T,C or G
gattgcgagggagcatngtaagagctagtatctcttctcagtcatagtgntggttttcctagctgctatggaaaggtttgttcacttatgagattaggacttttcttaaattcctcattaaatatgaacctaaggcatacccatcatttaccttgattcccatataatttgtgtaagtcatatataagtccattgnc

SEQ ID NO: 25102 - DNA, 500 bp, Homo sapiens
  misc_feature 6, 9: n = A,T,C or G
gaaggnagnccatcaaaacaaccagaaaataagcaacagaatggtagtagtaagtccttgctttatcaataataacactgaatgtaagaggactcggttctccaattaaaaggcatagaagagctgattggataaaggaacgagacccaactatatgctccttcaagaaacccacttcacctacagagacacacatagactgaaagtaaagggatggaaaaagattttccatgcaactagaaaccaaaaaagaacatgagtatacttacatcagataaactacaaatcaaagactgtaaaaagaaacacagtcactctgtaataataaagtgatcaattcagccagaggatgtaacaatgataaatatccatgcacccaacaccagagctcccaactatataaagcaaacatgaatagatctaaagggagagatagactgcattaatattaggagactttaacaacctgttctcagtaatgaatagataatccaaacaga

SEQ ID NO: 25103 - DNA, 380 bp, Homo sapiens
  misc_feature 8, 11, 377: n = A,T,C or G
atgccatngcnctccagcctgggagacagacccagaccctatctcaaaaataaataaataaataaaaatatagggaaagttgtttaaaaaaatcataggcttctgctgtctgattcctcttaagtactccacattcactttgttttatcaaagaaatcaaagctggaaattgaaaagtacattctatgcacttatatagtgtggtattctgtaactccaaactagttcagtactcaaaaggacttgcctgattatatgttgtaagattgatgaatgagtcacattatatgttagaaaaattttaagggaggtttgtatttctcttgatgaaaaatgttatatatatgaaagaaaagagtggtattatcactcaaatnagc

SEQ ID NO: 25104 - DNA, 288 bp, Homo sapiens
  misc_feature 2, 13, 32, 38, 39, 40, 43, 49, 50, 52, 65, 69, 77, 83, 158: n = A,T,C or G
gnaagacagcccngggcgcggtggctcacgcntgtaannncancacttnngnaggcttggcgggnggancacctganatcggnagttcaagaccagcctgaccaacatggagaaaccccgtgtctactaaaaatacaaaattagccagggtggtggcngcatgccttgtaatgccagctacttgggaggctgaagcaggagaatcgcttgaacctgggaggcggaggttgcggtgagccgagatagcaccattgcactccagcctgggcaaaaagagcgaaactccgt

SEQ ID NO: 25105 - DNA, 497 bp, Homo sapiens
  misc_feature 10: n = A,T,C or G
aagaaggacnggcaacccatgtctatcgttatcacagaggcgagtcgaagctgcgcatgtgcttggacatagggaatggtcagagaaaagacagaaaaaagacatcccttggtcctggaggcagctatcaaatatcagagcatgctccagaggcatcccggcctgctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacatcaatcctgttttaagtgctgactgggtcagcccttccgggactggagtctggtctctttcagtgctttttggttggttggttggttcaccatgttggccaggatgg

SEQ ID NO: 25106 - DNA, 500 bp, Homo sapiens
  misc_feature 20, 76, 77, 78, 361, 364, 396: n = A,T,C or G
cgactgtggatgtggtaganacagcaagagaacttgaattagaagtttccctgaaaatgtgactagattgctgctnnntcatgatcaaatttaaatggatgaggagttgcttcatagggatgaacaaagaaagtggtttcttgagatgagatccactcctggtgaagatgctgcgaacaacgttgaaatgacaacaaaggacttaaactatgacagaaacttaagtgataaagcagtggtagggtttgaaaggactgactccaattttgaaagaagttgtctggtgggtaaacagcattgcatgatacagagaaattgttcatggaaaggagagtacatggatgcagcaaaacttcattgntgncttatttaagaaattgccacaggcactccatncttcagcaaccaccaccctggctattagaaccatcaatatcaaggcaagatcttcaccaacaaaaagcttatgactcactgatggctcagatgatcatttagca

SEQ ID NO: 25107 - DNA, 359 bp, Homo sapiens
  misc_feature 9, 11, 27, 31, 38, 51, 58: n = A,T,C or G
aaatctccngngaggactttcaaatgnggtnacctcanctatatcactgcncaacttnagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatctg

SEQ ID NO: 25108 - DNA, 498 bp, Homo sapiens
  misc_feature 24, 57, 473: n = A,T,C or G
tgaattgcccagccagcgcagggncttctgctgagggggcaggcggagcttgaggtnccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaagggcgatcttttaaaaagagattaaaccgaaggtgattnaaagaccttggaaatccatgacgca

SEQ ID NO: 25109 - DNA, 298 bp, Homo sapiens
  misc_feature 4, 14, 15, 16, 17, 18, 20, 22, 27, 31, 32, 33, 35, 38, 42,45, 46, 52, 54, 55, 63, 67, 68, 71, 73, 76, 77, 78, 80,83, 85, 131, 144, 181, 182: n = A,T,C or G
actnacgactggcnnnnntntnagaanctgnnngntangatnacnntgcccngnntccagacnaatnnttntncgnnnangcncnttgtggaccaggtagagcaattactactcgttctgggcagaccttntccaaagtttggnacaactgtccttagactgatgagcaaaggaggagtcnnctaatgaagaaatgaataataaattttgacactgaaaaacattttattaataaagaatattgcatgagtataccagtttatatataaaaatgtttttaaacttgacaatcattaca

SEQ ID NO: 25110 - DNA, 500 bp, Homo sapiens
  misc_feature 12, 49, 52: n = A,T,C or G
cgaagaaaagancccgaagtattcaggctgccctggatagtgcatacanttnaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaccctgggatcccagacatcgtcgtgggagaaattagagaagaatctttctgataggcttggtgaatcccagaccttgctggcagcagcagttgagaaagaacgt

SEQ ID NO: 25111 - DNA, 427 bp, Homo sapiens
  misc_feature 3, 4, 57: n = A,T,C or G
aanntcgcccttcctttagtcaggaaggacgttggtgttgaggttagcatacgtatnaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcataccgcagatttctacagaaactacgatgtcatgaaagattttgaggagatgaggaaggctggtatctttcagagtgtaaagtaatcttggaatataaagaatttcttcaggttgaattacctagaagtttgcactgacttgtgttcctgaactatgacacatgaatatgtgggctaagaaatagttcctcttgataaataaacaattac

SEQ ID NO: 25112 - DNA, 258 bp, Homo sapiens
  misc_feature 3: n = A,T,C or G
canctgcccccagcactttgggaggcggggcgggcacatcacctgagttcgggatacagagaccagcctggccaacatggtaaaaccccgtctatactaataatacaaaaattagttgggcgtggtggtgcatgcctgtaattctagctactcaggaggctgaggcaggagaatcgcttgaacccgggaggcggaggttgcggtgagccgagatctcgtcattgcactccagcctgggcaacaagcgtgaaactccgt

SEQ ID NO: 25113 - DNA, 500 bp, Homo sapiens
  misc_feature 5, 10, 54, 491: n = A,T,C or G
aaaanctggncaacaatttttgtaaaagatggctactctgtagtgctttaactngacctatttagacaatgccttacacactggaggacgatactgtgtaaatctaataagtctacaagacaatacttctgtcttttggctctctccttcctctccagggtgatgacaaatcgtgagggtggagattatacctctctcatcatttcagcaccaaggaagtaaattagtggcagagtaagggaaacttgatgagtacatccaattgttgacatagttctgggtggagaaattttgctattatatcgacttcttaaaatagtctagtgggattaacttggtttcaattcacagagatctggaagcgaggatcttttaaaaatcctgaaatatacactgcaataaaagaacaaagcatacacctcagccttaaatgactgaagaagtatgtcaagtagcagcaggtgggaaagtggctttgggtttcagtttgngagctctga

SEQ ID NO: 25114 - DNA, 498 bp, Homo sapiens
  misc_feature 5, 53: n = A,T,C or G
gaccngggttaatagccagatagtaagaaccagtgaggagatgcggccaaagnttctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgcctcagggactgcaccctgacaagtgttaaggcaacattcctttcttgtgccctgggccaaaaccaatgctgatgaccttatcagcttctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcaagttataaaggcaaaggacgaatttgcacagtggatata

SEQ ID NO: 25115 - DNA, 500 bp, Homo sapiens
  misc_feature 9, 13, 55: n = A,T,C or G
tgggccagngaanatactgcaggcaggcttcagccatgttgtgaaactgataaangcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttgctgagtgaaggaatgatattcatatattcatttattccatggacatttagttagtgctttttatatcca

SEQ ID NO: 25116 - DNA, 429 bp, Homo sapiens
  misc_feature 4, 6, 53, 54, 56: n = A,T,C or G
cctncnaagttaattggtcccccagaaatgcacaaatatcactgtgaactcanntncttaagggagaaagaaaaacagctcgagacctcatgcaaagagaaaactgagtatctacagaaagtggttcagaggaatgaaagatataaacaagatgtggagaggttctatgaacggaagcgacatttagatttaattgagatgcttgaagcaaaaaggccatgggtggaatatgaaaatgttcgtcaggaatatgaagaagtaaaactagttcgtgaccgagtgaaggaagaggtcagaaaacttaaagaagggcagattcctataacacgtcgaatcgaagcaatggaaaacgagcgtcacaatttggaggctcgaatcaaagaaaaggcacagatattaaggaggcatctcaaaaatgcaaacagaagc

SEQ ID NO: 25117 - DNA, 500 bp, Homo sapiens
  misc_feature 2, 7, 56: n = A,T,C or G
anactgncctttggatatgtggaatcttatattatagtgtaagttctaatcttttnacaaggattttagctttttgtagctatagtactgtacaaacagcagaagcatggtacttgttgagaagtaggtgagaaactgtagttccaagctccttaaggatagagacatgatgtttactgttcttacccagtggctggcacagtataggcactgaatatatgttgactgaatgactatgaggaaaaacaagtattattaacattagctcatttcggtaaacctagcctaacacttaaaatatttctcataatattctaattggtcttattgtctacttattgccagaagttaaaatgcattttgctaatcagtcaatagaacctttgggaagaaaagtggaagggtctgaaacttcctccctcccacaaaaaggcctgaagattcctggcttagagcatgcgagcattgaaggaccaatagcaaacttatcaggtcttgga

SEQ ID NO: 25118 - DNA, 495 bp, Homo sapiens
  misc_feature 1, 56, 399: n = A,T,C or G
naatgatcccatttcaagcgttttaatgcattgcagtatctgcgtttacctcacancgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcaagaaaccagtcttccaccggatatgtatgaatgtctacgtgttgctaacgaagcactcttaattaatatctgtatcctggacaatattttatgggtatgtttttctgngggcaggtttcatagtatccatatttattactggttattacttccatgaattttaaaatctgagggaaatgtttgtaaacatttatttttttaaag

SEQ ID NO: 25119 - DNA, 146 bp, Homo sapiens
  misc_feature 1, 2: n = A,T,C or G
nnacctcacaccacctgagcaaaaaggcctacggtacggaataatcctatatattacctcagaagtttttttcttcgcaggagggggctgagccttttaccactccagcctagcccctaccccccaattaggagggcactggcccc

SEQ ID NO: 25120 - DNA, 497 bp, Homo sapiens
  misc_feature 1: n = A,T,C or G
naagtttccattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgttaaacaaccgttaaactcttagcctacaaggtgctcttatgtacatagttgttaatacatccaattaatgatgtctgacatgctatttttgtagggagaaaatatggctaatgatattttgagttaaaatatcttttggggaggatttgctgaaaagttgcacttttgttacaatgc

SEQ ID NO: 25121 - DNA, 500 bp, Homo sapiens
  misc_feature 14: n = A,T,C or G
cagccagcgcaggngcttctgctgagggggcaggccggagcttgaggtttccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaggataaaaggtttctaaaacatgacggaggttgagatgaagcttcttcatggagtaaaaaatgtatttaaaagaaaattgagagaaaggctacagagccccgaattaataccaatagaaggcaatgcttttagattaaaatgaaggtgacttaaacagcttaaagtttggtttaaaagttgtaggtgattaaaataatttgaaggcgatcttttaaaaagagattaaaccgaaggtgattaaaagaccttgaaatccatgacgcagggagaattgcgt

SEQ ID NO: 25122 - DNA, 100 bp, Homo sapiens
  misc_feature 2, 11, 54, 61, 92: n = A,T,C or G
gnccgaaaaangtctctgttgaacgtaatgctacctgactgctcgatctatcangcgccgnaaaggcatcggatagtccgaaatgtaacagntgtgggtt

SEQ ID NO: 25123 - DNA, 130 bp, Homo sapiens
gatgtttgcaatatgcatcaagtttgaggacctctgatttaagctgtgtgaagtgttttcaactgtcccgattcagagaacagagtcatgtaatggctcagaggattcctccacccacttacacacacac

SEQ ID NO: 25124 - DNA, 497 bp, Homo sapiens
  misc_feature 2, 9, 37, 41, 57: n = A,T,C or G
ancaggccnagccaaaaccctgatttataatcctttntttntcatgagtcattttcnttactattattccaaccaaaatcattaatcacattcaacctaatgacccaactcaagttgatgctaaagagcacaaaaatgacacttgaaactgaccatgataacaagcttcttcgatcaattcgcaagcccctaccttttaggtatcccccttatcctcgttgccatacttctaccttgacttctttttcctgctccaacatcacgatgaatcaacaatcgacttatcaccgccaaacatgattgactggacgattcacaaaccaacttatgaccccactaaactttagcggccacaaatgagcacttttatttgcctctctaatagtattcttaatcacaattaatcttttaggacttcttccttatactttacaccaacaacccaactctctctgaatataggatttgcagtacccctatgacttgccacagtaatt

SEQ ID NO: 25125 - DNA, 499 bp, Homo sapiens
  misc_feature 2, 33, 39, 67, 75, 284, 335, 362, 484, 487: n = A,T,C or G
anactcatggcacaattgacttccctgaatttntgattntgatggcaagaaaaatgaaagacacagncagtgaanaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtgaagaccttgnacagaatgtgttaaatttcttgacaaaattgtttatttgccttttctttgnttgtaacttatctgtaaaaggtttctncctactgcaaaaaaatatgcatgtatagtaattaggacttcattccttcatgtttcttcccttatcttactgcattgtcctaaaaccttattttagaaaattgacaagtacatgttgcatgnggntactctggatat

SEQ ID NO: 25126 - DNA, 208 bp, Homo sapiens
  misc_feature 40, 96, 171, 194: n = A,T,C or G
attcgggccgagatgtctcgctccgtggccttagctgttntcgcgctactctctctttctggcctggaggctatccagcgtactccaaagattcangtttactcacgtcatccagcagagaatggaaagtcaaatttcctggaattgctatgtgtctggggttcatccatncgacattgaagttgacttactgnagaatgggagagag

SEQ ID NO: 25127 - DNA, 254 bp, Homo sapiens
  misc_feature 1, 58, 228: n = A,T,C or G
naaaatgccccagaaagcgtggggaaaagagctctctgggatccttcttataaggctnctattcccattcggagggctccactgtcatgacctagttaccttccaaaggcctcatcttcaaattggggattaagatttcaacatacgggttttggggggacacaaacattcagtccataaaagtcattatagtcctttgcagtcaatagttgcctctccctactcctnctaagagacaaccatcattctgactt

SEQ ID NO: 25128 - DNA, 500 bp, Homo sapiens
  misc_feature 8, 9, 493: n = A,T,C or G
aaccgatnncagagaaaattttgcatgcaaaaatttaggaagatgaatgatactcattattattattctttcagtccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgcattgttgaaaggacaccgcagggaccactggcagtacctatgtggaataagcatggatgctagttcactgtggagttgagatgcattttacataattatgagtttggtcatataaagaaaagctgtggaaaaagagtcttagagattttgtaatatcattctaaatagattaagaaaagatataatttctttactgcagtaaatcatataatgtttgnatgatta

SEQ ID NO: 25129 - DNA, 100 bp, Homo sapiens
  misc_feature 22, 26, 31, 37, 56, 57, 58, 87, 98: n = A,T,C or G
aaaatgtccgtgaaaatgaganctangcatnactttngccaaagtaaggcctttgnnntatatttatataggccatacatagagaantcacctagctnta

SEQ ID NO: 25130 - DNA, 180 bp, Homo sapiens
  misc_feature 10, 26, 29, 40, 49: n = A,T,C or G
atactatatnaaaacaaacaacaacnacnctttctgattngtctaccangtctggtccaggtatagtacaaagaagtgaaatgttctcagccaaaacataaaagattgtttaatagttataaaatgaacatttaacacaaaatttctgggagcaaatatgagaaaattctgctaatatag

SEQ ID NO: 25131 - DNA, 498 bp, Homo sapiens
  misc_feature 1, 2, 58, 59, 377, 400, 465, 487, 494: n = A,T,C or G
nnactaccccgtcataaaaaagaataaaagcatgtcttttgcagcaacatttaatgannctctaggccattatcttaagtgaagcaactcagaaacagaaaaacaaataccacatgttctcacctaaaagtgggagcttaatacttaatgagtacaatgtacattattcagtgatgaacactctaaaagcccagacttcaccactatgcaatatattcaagtaacaaaattgcacttttgccccttaaatttatacaagtataaagaactgcacaattaaagcaaaatagtacagtatacaaccaatataaatggtgcaactcatctacttaaattttgaaaaaagaaaaagctaaggtgtattaatcaaatgctgngggtgtgatactgggaccagatnaagataatttagtatacaaatatgctggaaggtcagccattaaggttcaaatcaaacgaaaattncacaataaggctacttcagctnattaatnaatt

SEQ ID NO: 25132 - DNA, 271 bp, Homo sapiens
  misc_feature 6, 48: n = A,T,C or G
ctgggntgaggcggaggagaacttccagaattatggcgaagtccgttntgaggcaggacccgcagagcacagctgcaagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtcttgga

SEQ ID NO: 25133 - DNA, 237 bp, Homo sapiens
  misc_feature 1: n = A,T,C or G
nacaaacccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattc

SEQ ID NO: 25134 - DNA, 133 bp, Homo sapiens
  misc_feature 15, 49, 110: n = A,T,C or G
cagccagcgcagggncttctgctgagggggcaggcggagcttgaggttnccgcagataagtttttttctctttgaaagatagagattaatacaactacttaaaaaatatngtcaataggttactaagatattg

SEQ ID NO: 25135 - DNA, 498 bp, Homo sapiens
  misc_feature 1, 7, 239, 464: n = A,T,C or G
naaaggncccgaaaacacttcccatttacctgttgttgctgctgtctgttttcgtgtttcagcaagtttcatctcaagagctttcctgtaaaggccgctgctttgagtccttcgagagagggagggagtgtgactgcgacgcccaatgtaagaagtatgacaagtgctgcccgattatgagagtttctgtgcagaagtgcataatcccacatcaccaccatcttcaaagaaagcacctncaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcaagctgctaatagaggaattacnggaagaactcaaagtaaaagataccaaggaggac

SEQ ID NO: 25136 - DNA, 108 bp, Homo sapiens
  misc_feature 89, 95: n = A,T,C or G
tacgactatagagactagttcaggcctcccagatactgacaaacgtggggaagtgacccagctggctggcaacctggcagaggaccatnatgccngctgtcaaaagag

SEQ ID NO: 25137 - DNA, 178 bp, Homo sapiens
  misc_feature 18: n = A,T,C or G
aagagcacaaggaggttnagagagaccctcactgctggggagtccctgccacgctcagtcccccaccacactgaatctcccctcctcacagttgccatgtagaccccttgaagaggggaggggcctagggagccgcaccttgtcatgtaccatcaataaagtaccctgtgctcaaccg

SEQ ID NO: 25138 - DNA, 330 bp, Homo sapiens
  misc_feature 47, 327: n = A,T,C or G
actaaagaaagattatatataactatgctaattgttcataatcaacntaaaccaagatagagctacaaactcagctgtacagttcgtacactaaactcttcttgcttttgcattataaggaattaagtctccgattattaggtgatcaccctggatgatcagttttctgctgaaggccctactcagtatcttttcctctttatcactctgcattggtgaatttaatcctctcctttgtgttcaacttttgtgtgcttttaaaatcagctttattctaagccaatctgggctactttaaaaaactgggaatgggaaaaaaaataatcnttg

SEQ ID NO: 25139 - DNA, 475 bp, Homo sapiens
  misc_feature 2, 390, 410, 429, 432, 462, 465: n = A,T,C or G
tnaaaaacccgcttgctttcatattagttttttttatatttttatatcttttggatttattttcttggaacccaattggaaataagtcaggtatgaccatttaaagagactaaagaagtgattcagtttctcatgtaaggaaaatattttagtttgtggggagatcaagtcattgcagcctagactgttaactatcttcaacacattttctaatattgtagcattgcctatcaatttatattacatataagcctcagctatgtttactgccagtaatattgctcactggaagatcaaggccacatgaaagccatttttcaaatagttcacatatatctatattgcacttaacaaacttttgggccggcacagtggctcacacctgtaatnccagcccttgggaggccgangcaggcgcatcacctgagncangaggtcaaaaacagcctggccacatgatgnaancccatctttt

SEQ ID NO: 25140 - DNA, 476 bp, Homo sapiens
  misc_feature 2, 342, 400, 420, 444, 460: n = A,T,C or G
gncaaaaacccgtcattcaaggacctccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgcagatgatgaagtcattggttttttcaaaattggggtgaaatatcactgnccaatgtgttcacttatgtgaaagctaaattgatgagcaaaaagagcaaataggttgnatatttggtaatccttttgnatttcttacaataaaaatattggnagccaataaaataatnaaaccatacctttaac

SEQ ID NO: 25141 - DNA, 498 bp, Homo sapiens
  misc_feature 7, 55, 57, 449: n = A,T,C or G
taaaggnccccacttccggcgtagccatggcggctaacgctactaccaacccgtntnagctgccgcccttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgcttacactagattttgttttggcttataatgacaagaaaatggaattttttttcccactttctaatgtttaaatcccataaagctaagtttcccgttaaagggaaagtgctttgaagatgtgtcccatttttgnaaggtaatcatgattatcctggaaaaagaagaaaagagcttcttctttg

SEQ ID NO: 25142 - DNA, 289 bp, Homo sapiens
  misc_feature 12, 40, 43, 44, 53, 59, 75: n = A,T,C or G
gcagcgcagggncttctgctgagggggcaggctggagctnganntttccgcanataagnttttttctctttgaangatagagattaatacaactacttaaaaaatatagtcaataggttactaagatattgcttagcgttaagtttttaacgtaattttaatagcttaagattttaagagaaaatatgaagacttagaagtacgggaaggcgaagaaaagaatagagaagatagggaaattagaagataaaaacatacttttagaagaaaaaagataaatttaaacctg

SEQ ID NO: 25143 - DNA, 349 bp, Homo sapiens
  misc_feature 2: n = A,T,C or G
anataacctataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtatatcagtttatatataaaaatgtttttaaacttgcaatcattacactaaaacagatttgataatcttattcacaggtgttattggttacagaccatttaattaatatttcctctggttattcctcctcttcctcccattgcatggtcacacctgtt

SEQ ID NO: 25144 - DNA, 252 bp, Homo sapiens
  misc_feature 16, 26, 42, 50, 63, 67: n = A,T,C or G
taaccttcctgtactntagtccaggngccaagaatttccctnctaccctntattttcttgtgnccgnaagttacaaagtcaggaaaagtcttggctggacccctttcctgctgggtggatgcatgtggtccaggactggggtctgggcccaggtttgagggagaaggttgcaagagcacttcccacctctctgaatagtgtgtatgtgttggtttattgattctgtaaataagtaaaatgacaatatgaatc

SEQ ID NO: 25145 - DNA, 500 bp, Homo sapiens
  misc_feature 5, 9, 464, 467: n = A,T,C or G
tgagnccangtaaaacactaaagactaaagactgataagagaaaggcaaataatccaatacaaaaatagtcagagaatttgaaaaggtgattcgcagcaaatgagcaatttggtggaatttctaggtagaactgaaaatgaacaaatgatttagcaatttcacttctatgtatactctggaaaagaagtagtcaaaaatatatttaagtcctttgaaataattgacttcagtacccctttaatgagcatttattaagcttctgctatatgtcaagtactatctgctaggagctgggaatcaaagatgaataagacaggtttcttgccctccagtaattgatgatgtgctgtgagagacaagaacttcaatggtaagtacaatgcacttgattaaagtctatattagttaagggtcttaactaagaattttaaagggatgatgggcatctcttagatagaactgnctncatattactgggtttgctgatttagtctaattt

SEQ ID NO: 25146 - DNA, 194 bp, Homo sapiens
  misc_feature 13, 21, 39, 43, 48, 51, 61, 65, 134, 143, 154: n = A,T,C or G
taacaagcccggnacctggtnatttctccagatccaagnacanatacnttnagcctcaggngtgngcaggactcccttacaggatatcctggctgtgtgtgtgtgtgtgtgtgtgtgtgtgtgtgcgcgcattngacacacanagacagaaggncttgggaaggagggagagagaaaaagagagagaggagagt

SEQ ID NO: 25147 - DNA, 213 bp, Homo sapiens
  misc_feature 5, 10, 38, 109, 137, 209: n = A,T,C or G
aaagnatttnagatgcgactgaattgctgcaatctcangatcaaatttgaatggatgaggagttgctttttagggatgagcaaagtctgctccttgagggcaggacagntcttatggctttatccgttgcgtaagcncagagaggctgcgaggtcaaaactattgtcatgatagcaaagatgcctgctttttcatctattctcaccggngtgc

SEQ ID NO: 25148 - DNA, 387 bp, Homo sapiens
  misc_feature 7, 11: n = A,T,C or G
aaacaancctntggatgagcttttatatatggaacttactccaacaggactgaggttccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtg

SEQ ID NO: 25149 - DNA, 496 bp, Homo sapiens
  misc_feature 1, 59, 89, 244, 369, 492: n = A,T,C or G
naaaaagcccccaaaaaacccacttctaccaaaaagccaaaaacaatgcctagagtgtnaaaaccaaagacgacaccaactccccgcangatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctnatatgcttctcaggccccatgtgttcatgcctgaagttactcccgcatggattacttaccgagagtcccaatcaaggcattatcatcaatccatgctttccgatgagacaatatttgcaatggtnagccagtagatggactgactcttgcgcaatgggacattagttgcattccgaggcattatttctgggatgctaagtccattcagtccaccatcttcagctcgcagaattactgaggttgggggnattc

SEQ ID NO: 25150 - DNA, 305 bp, Homo sapiens
  misc_feature 26, 97, 98: n = A,T,C or G
aaaggggataaatgtgctaattaggnagtaaacatctactctcatattcttcccatcctttattacctttttgtctatatcctaggagacattcttnnctattttttcagacctactgttaataatggggtaataagaggctgtagattaatagcagttcacattcatgtggtactatcgaggtgccaggtactggactaaatgttttcattacctcatttaaagcctggagagttaaagtattttctctgaagtcacataacttgtaaagaaagaagctgagattagttttacagccctcactt

SEQ ID NO: 25151 - DNA, 498 bp, Homo sapiens
  misc_feature 1, 57, 403, 450: n = A,T,C or G
naaaaaacccaaccatatatagccagggaaaattctagaaaaatacgggataatttnactcacaaagttataaagcctcaataattaaatagcgtgttcctggcacatggataaagagatcaatcaagggaagtatattagcgttctccagagaaacagaaccaataggatatatattgtattagtccattttcacactcctataaagaactacctgaaactgggtaatttatgaagaaaggaggtttaattgactcatagttccacaggcttaacaggaagcatgactgggaggcctcaggaaacttaaaatcatggcagaaggcaaaagggaagcaaggaccttcttcacatggtggcagaaagagagagagagagatgggggaagtgccacacacttttnaaccgtcagatctcatgagaactctttcactatcacgagacaggtanggaggaaatcacccctcatgatccccttccctgacacagggggattac

SEQ ID NO: 25152 - DNA, 329 bp, Homo sapiens
  misc_feature 6, 24, 32, 34, 41, 57, 58, 59, 60, 61, 62, 71, 83, 109, 228,272, 285, 287, 306: n = A,T,C or G
aaggangctgatcatgaattatanttgctttntnctagaanaagcattgaaatgagnnnnnnttgcttttncattttccctgngctttatatgctcttcgcaatacatnatgtccaacgggatacctattgttctcatgacacccaaaattgatgagagcaaaggggtcgcaccatatggaaatgttgaaaactattgtaaagtagtattatgaagtagcttttgtgncattcatgtcgatgacatgaaagtgaaggaaatttattctatgnaaattcacactananccaggacagtccataagtngaatcatgtaagaatcacctagt

SEQ ID NO: 25153 - DNA, 497 bp, Homo sapiens
  misc_feature 2, 12, 27, 28, 32, 36, 38, 40, 41, 44, 49, 50, 57, 62, 98,100, 102, 328, 372, 405, 417, 452, 479, 497: n = A,T,C or G
cngaaggacacntcacaccagcctganntttnttantncnngcnttttnncatcctnctggntagatcatatgttagatgaaaaaataagttccactnantncaaaacatcaaactgatatcaagtatcttttctcttcataacacagtaaatttagaaatcaataacaagaactttcaaaactgtacaaatacatggaatttgacaacatgctactgaatgaccaatagattaatgaggaaattaagaagggcattaaaatgtttctggaaacaaatgaaaatgaaccacaacataccaaaacctatgggatatagtaaaaggagtnttaagaggcatgtttatagcaataagctctacatccaaaaagtngaaagatttcaaagaaacaacctaatgatgcanctcaagaaactngaaaagcaagaacaaaccaaacccaaaattagaangaagggggtaaagataaacagaaattnacaggattggagactaan

SEQ ID NO: 25154 - DNA, 120 bp, Homo sapiens
  misc_feature 9, 31, 39: n = A,T,C or G
atataccantatggaaagagtgatcacgggnagaattgntgtttcagttgagaaattagtggcgcggtggagttcatctcgaatgattactaggtctaggacaggtttaaaggttaggga

SEQ ID NO: 25155 - DNA, 453 bp, Homo sapiens
  misc_feature 5, 25, 45, 76, 335, 378, 400, 418, 431: n = A,T,C or G
cgganacaattttgataccccagcngaagctggtggtctcaaggnttcgacgtcataatcagcatcaatggacagnccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggacgaggactctgggctgcttggaataggacactcaagacttttgactgccattttgtttgttcagtgggagactccctggncaacagaatccttcttgataggtttgcaggcaaaacaaatgtnatgttgcagatccccaggcagnagctctgccttctgtatnctatgtatgcagngggcctttttcttgccagcttg

SEQ ID NO: 25156 - DNA, 350 bp, Homo sapiens
  misc_feature 10, 11, 56, 324: n = A,T,C or G
aaatgacccnngtgtttaaaatttattgcattgcaaagggtagtttcactgaagtnatgcaccattaaataagatgaaatatttgtatttattgtcctacttcctaagccgtaacttcttttcctctgtgaatttgcattgagtcactcatgctacactacatcgctttagtatttgaggtggcatttatgtttcctctcgtttatcatgaaatggggcagattccatcagattccacctctgtcaggtggactcttgctgccttcatgatgagatttttttttctccttcccctttctttaagagaggctgacagatctaggngtcaatcaattggaaaccaggctctg

SEQ ID NO: 25157 - DNA, 354 bp, Homo sapiens
  misc_feature 11, 24, 38, 52, 59, 60, 68, 89, 90, 96, 346, 350: n = A,T,C or G
aaaaatcccanaagacatacactnatatgttgattgcngctacttttcacangagcttnngacatggnatcaacctagatgctcaacannagtggnctggataaagaaaatatggtacagatacaccatggacaaccattcagccataaaaaagaatgagattatgtcctttgcagcaacatggatggagttggcggccattatcctaagcaaactaacacaggaacaggaaatcaaataccacatgttctcacttacaagtgggaactaaatgctgagtacacagggacgcaaagaagggaacaatagacatcagggcctacttgagggcagagggtgggagaanggtnagga

SEQ ID NO: 25158 - DNA, 402 bp, Homo sapiens
  misc_feature 15, 24, 47, 48, 55, 65, 141, 178, 221, 232, 362: n = A,T,C or G
gactgctttacctcnttgggcatngttcctggccatcatcctcttcnnctttggnttcatttgcngtgtggccttgaggaagcgacgatgccccaactgtggagccaccttcgcttaaagggaacaccaggcccggctttnctacacccagctctctttttctaatgtaaatgttggngtacaatagttttatttgattaagcttcaaggactgttttgtnaagcgaggtgngacccgatgtggcacacgccagctgcggtttcccggagcgtggagaggcagtgctgctgctccccgcccgaggctcatgacaactcaataaagcactggtttattttttggagcttcaattgagaaaggngagaaataatggttttcaataaatgagattcataccattg

SEQ ID NO: 25159 - DNA, 311 bp, Homo sapiens
  misc_feature 13, 30, 36, 42, 45, 75, 78, 87, 89, 90, 94, 103, 112, 198,238, 266: n = A,T,C or G
ctacctcacattnaactggctgacacttgnaatacnatgcangantctttagacagaagactggcttggtggacntcntgcctgatncnnactnttactcatnacctgcagnggccagaattagggactcagaatcaaaccagtgtaaggcagtgcctggatgccattgcctggcacattgaaattggtggcttcatnctagatgtagcttgtgcagatgtagcaggaaaataggaanacctaccatctcagtgagcactagctgnctcccaaaggaggggcagccgcgcttatattttatggctacaatg

SEQ ID NO: 25160 - DNA, 101 bp, Homo sapiens
  misc_feature 3, 80: n = A,T,C or G
ccngaccaacatgggaaatcatcaaaggagctggagttagacctttccagagtggaagagaaaaggaccagagactggtnctgtatagctccaacattagt

SEQ ID NO: 25161 - DNA, 496 bp, Homo sapiens
  misc_feature 1, 8, 58, 350, 399, 401, 411: n = A,T,C or G
naaagtgnccctatcacaactcctggtgtgaggttttataatgacccagctggctatncaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgtcaagtggctgtttttttctgttttggaacaacacatttttgtaatgcttgcatgatgattttcaaagaatgactagcattcctaangaagaactaccacactgtcctgcaggtcccaaaggcaagcaggtagaangnactgaatgtncactccatgttgtcatcacccctggggaagagttgctctgggatgtggagtggcagaaatgccacacttttaaaacacgcagatc

SEQ ID NO: 25162 - DNA, 264 bp, Homo sapiens
  misc_feature 2, 10, 36, 38: n = A,T,C or G
tnacaccttnatcactatccttgatgcattcacctncnggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtcag

SEQ ID NO: 25163 - DNA, 183 bp, Homo sapiens
  misc_feature 28, 46: n = A,T,C or G
tggatttttttttaaagtcttcagcatnctaattcaccctttctancttaagaaaaacatgacttaagacactgcttctaagtttggttgttctttatagtgtggatacccagttatctgtgagcgtatgggggtgggctgagggtcaggtgaggaaggagagtgtgtgtgtgtgtgtgtgtg

SEQ ID NO: 25164 - DNA, 333 bp, Homo sapiens
  misc_feature 18, 55, 212, 254, 297, 327: n = A,T,C or G
aaaaatcccgtgtgggancagacgcgtgggcgcattgcgggcagctatgtttccngtgtcctctgggtgtttccaagagcaacaagaaacgaataaatctctgccataggagttttagccaattcagaggccttgctgcccacaatttggaaaattcctttggatttgaccaagtcaggaagagacgggagaaaagtgaaacaacaacaatnaagccccaagcataaacagacaaaaagagttaagcaaaacancaaatgcacaattcatatgattactgagtgttctaatggtaanggagaaactaaaaagcagaaattaaaagcngctgac

SEQ ID NO: 25165 - DNA, 500 bp, Homo sapiens
  misc_feature 4, 12, 432, 455, 483, 489: n = A,T,C or G
tganaaacaccntttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttggcaaggttgggacaaagccatctgggcagcagggcaaggactgttggaggagaagttagcccaagtatangctctgccagatgccatcacatncctgatctgtgatgctttgaacaccttncctganaagggaaaaag

SEQ ID NO: 25166 - DNA, 201 bp, Homo sapiens
  misc_feature 9, 57, 199: n = A,T,C or G
atgatgccntaatactttatatttttgcttataatgacaaccaccagttctttttcncttaagttaggttgagaaattttatttaatggccactgaagggccattttcaattgggaaaatttatttacatctgtggtaaactttattttgatgaaaagttgcactagtattttaccaccagatgagaaaaagatgagcntt

SEQ ID NO: 25167 - DNA, 497 bp, Homo sapiens
  misc_feature 3, 8, 30, 463: n = A,T,C or G
gcnggcgngcctagaggattctcgcagatnagtttttttctctttgaaagatagagattaatacaactacttaaaaaatatagtcaataggttactaagatattgcttagcggttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaggtgattaaaagaccttgaaatccatgacgcaggnggaattgcgtcatttaaagcctagttaacgcatt

SEQ ID NO: 25168 - DNA, 366 bp, Homo sapiens
  misc_feature 28, 358: n = A,T,C or G
aggccttctccttgagcaaggctgagantccagactgcatggaacgcttgcggctgcaaaggagactgggttgtcggacattccactggtttctggccaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcaagcccacagcacctgtgctttgctgtcaggcaggagcaggtgattcttcagaactgcacgngggaaagg

SEQ ID NO: 25169 - DNA, 437 bp, Homo sapiens
  misc_feature 5, 7, 54, 363, 426: n = A,T,C or G
tctancngcaattcacctactcactaaaatgtatatgtaaccccaaaatctgtntttgcaggagcttttacggtcatttgctgacttgcacagagcagtgctagacatgcatgtttcagctgaggttgaacaaggcagagctctgccttcttgtttcggctgtcacactgtcaacaagtgtcctttttgtggtccatttaagtgccattgtttctgcattgatgtgtttttgtggtaatggcactgtttaaaatggccgtaagtgtagggctgaagtgctgctcgtgtcctaagtacaacaatgttgtactgtgctgtactgtgctgtgtgcagaaacatgtgtgtagataagctttggtcangcacgaagtatagtgctgtgactgagtcaagtgggaatgaattatcagacagagccttatttngatatcatctt

SEQ ID NO: 25170 - DNA, 467 bp, Homo sapiens
  misc_feature 2, 12: n = A,T,C or G
gnatgaaggacngaggtcccagaagacgcctagtacaccacgaagggtcacacaaggggcttcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggacgcaaagactgg

SEQ ID NO: 25171 - DNA, 343 bp, Homo sapiens
  misc_feature 9, 16, 29, 36, 51, 52, 82: n = A,T,C or G
ccgctagcnaataaantttatattagatnaaccatncttgatccatttatnngtgtattcctatttgtgagttatttatggnaagctcactttccactccctgatctgaagttcaaaaaactggtataaatgcttggaagaaactcaatgaaaacggttgttctagttcaataggatcataaccatatctgtgtttatataggccctgagaataacataatggtattcaagtatcttcagagaataatgctgggccaacaaggagtttgagattgccctacaaatgatatggcttgccaaccaacctaatgttggatgatgctatttaaacagaagtttacga

SEQ ID NO: 25172 - DNA, 411 bp, Homo sapiens
  misc_feature 2, 11, 47, 366: n = A,T,C or G
anatacgtttntttaagctatacctgccatagtgattcctctggtgngatctggacaaagtgagttgaaaaccttctggaaaggatacatcatttgagataccattaagaacattcatgattcatgggaggatgtcaaaacatcaacattagcagaagtttggaagaagttgattccagctctcatggatgacttggaaggcttcaagactttagtggaggaagtaaagtgcagatgtggtagaaatagcaagagaactagaattagaagtggagcctgaagatatgactgaattgctgcaatctcctgataaaactggaatggatgaggtgttgcttttccttaaagataagcaaagaaagtggntcttgagatggaagctatcctggtggaaatgctgtgaacattgcc

SEQ ID NO: 25173 - DNA, 443 bp, Homo sapiens
  misc_feature 5, 6, 442: n = A,T,C or G
tgccnnatggtgaaaccctgttgctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaaggaaatttcaagttgccaataatagcattctctctgcatttaaaaataatttctatcaaaatacatgcataattgattttacacctcattactggng

SEQ ID NO: 25174 - DNA, 427 bp, Homo sapiens
  misc_feature 19, 23, 29, 36, 42, 43, 405: n = A,T,C or G
aaaaattccctgcctcatnagtncgcccnactgatnctgaannggagagagtctgtttagaattgattcagaaaagtgtctgtgaaagaaaaacaattattttgtcctgtttctcaaacagtgttaagcagttttgttaataggacatttttgcatcaacacttcaacattaacactttcaaagtcatggctggtgccagatttaagaaactcgaaccacctaatatttcataaccttcttcattaggtacttgtcagattaatttctaacattgcagcagtttcatatgtgtgcaatatgtgcattctttcattttagttttgcacttggttttctataaagtacgtttttactcagtcatgcgtgaacaattaaaaaacgacagaataaggacaaatgtgggnatttaataaactgtcaccaaag

SEQ ID NO: 25175 - DNA, 300 bp, Homo sapiens
  misc_feature 5, 10, 36, 37, 297, 299: n = A,T,C or G
tagcngctgnggctgcatgggttccgttcattctcnncatttctcaaatctggctctccagacttcattggcaattgtgttacgtaatacgttcagtttctgtttaattagccagtcattgttggttgtttctatctaagaaccaggtctgattcatttactcatttccctaataattttttgagtacctactatataccagacactcttttggatgggaaagaaagagcaatgattaagacagacaacgtattttctcttataaagactgtattttgtagggcaaatgaataaatnant

SEQ ID NO: 25176 - DNA, 351 bp, Homo sapiens
  misc_feature 4, 24, 31, 39, 56, 236: n = A,T,C or G
gaanggccctgtagacattcttangacagcngggatgtnacttaacattttttttnagctaaagtcagggaatcaagccatgcttaatatttaacaatcacttatatgtgtgtcggaagagtttgttttgtttgtcatgtattggtacaagcagatacagtataaactcacaaacacagatttgaaaataatgcacatatggtgttcaaatttgaacctttctcatggatttttgntggggtgggccaatatggtgtttacattatataattcctgctgggcaagtaaagcacactttttttttctcctaaaatgtttttccctgtgtatcctattatggatctggttttg

SEQ ID NO: 25177 - DNA, 487 bp, Homo sapiens
  misc_feature 10, 31, 57, 423, 444, 473: n = A,T,C or G
aaacttgccnactagtgaagaacatcaaagntgggtatttcaatgtgccaagtttgnttgaactaggttcggtttgcctctttcataacaatgtaaacacaatggtgtagttaattaaattctgggtggataggagcaggactgattactatgtcttgcccttcgccctttgtttttttcagaaccaaataacagaaatgtgtatgtgtgtactgtatctgcctttccaccacatttttatgacactgtattccactgcctgcttttttaccttctttccctaggatttgcctacagcttagtattgtggttgcagcgatctaggctgacagcacagaagcacaagagaagagtgaaggcaagaattcaaagcatttgtcatacaatgtgcacctctttgcatagttgcgtaggacctgttgnaatgctatcataaatattcgnaggttttttttttctctccaactggggcntgaccctttttttg

SEQ ID NO: 25178 - DNA, 299 bp, Homo sapiens
  misc_feature 22, 57, 59: n = A,T,C or G
acattgccgcagccagcgcagnggcttctgctgagggggcaggcaggagcttgaggntnaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggttctaaaacatgacggaggttgagatgaagcttcttcatggagtaaaaaatgtattt

SEQ ID NO: 25179 - DNA, 228 bp, Homo sapiens
  misc_feature 3, 14: n = A,T,C or G
ccntcaaaccccanaccccaactctggatgagcttggcaagtgatttatttagattctccgtgcctcagtttcaaggtttcctcttctgtaaaataaaaatattcccaactggccaggcatggtggctcacacctataatcccagcattttgggaggccaaggcggcagatcacttgaggtcaggagttcaaaaccagcctggtcaacatggtgaaacctcatctctc

SEQ ID NO: 25180 - DNA, 315 bp, Homo sapiens
  misc_feature 5, 6, 273: n = A,T,C or G
gaccnngtggactagcccccaactaggaaccccccaagagttgcctctttagagcaaaaaacacttatattatgcaggaaattccaagtaggagctctgtgccaggaaccaggggcagagatcaaatatatgtttcttatcatatcacaatatcacagtgaccaagtaattttctggatggatcaaagtcttaagacctgaagtggtaatcttgaatcagtagtaactcaggcaaacctgtgactgagtggcataaagtgtaaatatttttgnaagggaaatttaaataagattctaattattataatagccaag

SEQ ID NO: 25181 - DNA, 119 bp, Homo sapiens
  misc_feature 23: n = A,T,C or G
accacaccttaccacgagccatngataatgcaaaggaaaagaggactgtagtggtttgtctgtgatggctggaagttcctctgtaccagttgctgtggttggctgataaatatttgtcg

SEQ ID NO: 25182 - DNA, 189 bp, Homo sapiens
  misc_feature 46: n = A,T,C or G
gtggaggcccatgcatcccgcgcagatgacaccatcaaccgccagngtcccagacaccggttttcctagaagcccctcacccccactggcccactggtggctaggtctccccttatccttctggtccagcgcaaggaggggctgcttctgaggtcggtggctgtctttccattaaagaaacaccgtgca

SEQ ID NO: 25183 - DNA, 498 bp, Homo sapiens
  misc_feature 27: n = A,T,C or G
aaataagccgatgagagtttagttatntgtatgagtgtaaaagaggccacatctgttaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcaagtttcctctacggatgagagactgctcaagaatatcctcatgcagctttatgaagccaactctgaacacgctggttatctaaatgagaagcagagaaataaagcaagaaaattacctggatgaaaagaggcttttggctggggccatcccattgccttctcttaagggactttaagaaaaactaccacatgtatgtgtatcctgtgca

SEQ ID NO: 25184 - DNA, 491 bp, Homo sapiens
  misc_feature 9, 10: n = A,T,C or G
cttgagganncccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagactaaaatgaaggtgacttaaacagcttaaagtttagtttaaaagttgtaggtgattaaaataatttgaaggcgatcttttaaaaagagattaaaccgaaggggattaaaaagccttgaaatccatgacgcagggagaattgcgtcatttaaagcctagttaacgcatttact

SEQ ID NO: 25185 - DNA, 307 bp, Homo sapiens
gatgaaccctctaaagaaaatttatgaagatggagacgatgatatgaagcgaacctttaataaagcctgggtggaatcaagagagaagcaagccaaaggagacacggaattttgagactttaaagtcgttttgggaactgtgatgtgatgtggaaatactgatgtttccagtaagggaatattgggtgagctgcatatataaatttgacagatagctatttacatagccttctaagtaaaggcaatgaattctccatttcctactggaggatttatttaaataaaatatgcttattaaacactcctg

SEQ ID NO: 25186 - DNA, 463 bp, Homo sapiens
  misc_feature 6, 11, 31, 47, 48, 49, 429: n = A,T,C or G
aagaancatgnaaaagagcagtagaatgtgngtagtgctcattaagnnngtataaaacattcatttcaattgccaaaccagcagataaaccatccttttatgtttttctccatattctgcaacacgcgttagagtgttatgtatttggagacaagggagtgtattttttcatctttgtatatccagttcctcatatggttctttgttaactgtcaaatgaaatattgtatatatttatggtagtatacaacatgatgttttaatatatgtagatattatggaaggattgaatcaagctaattaacatacccatcacttcacatacttaaccaatttttgtgataagaaaatttaaaatctgcctcttagcagttttcaagtatagttggcccccacatttgcagattctgcatcaagcagattcagttnaccacggataaaaaatactcaagaaaaacccagc

SEQ ID NO: 25187 - DNA, 499 bp, Homo sapiens
  misc_feature 18, 35, 70, 412: n = A,T,C or G
gcttctgctgagggggcnggctggagcttgaggtntccgcagataagtttttttctctttgaaagatagnagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgatggaggttgagatgaagcttcttcatggagtaaaaaatgtatttaaaagaaaattgagagaaaggactacagagccccgaattaataccaatagaagggcaatgcttttagattaaaatggaggtgacttaaacagcttaaagttagtttaaaagtgtaggtgattaaaataatttgangcgatcttttaaaaagagattaaaccgaggtgattaaaagaccttgaaatccatgacgcagggagaattgcgcattaaagcctagtt

SEQ ID NO: 25188 - DNA, 340 bp, Homo sapiens
  misc_feature 4, 5, 74, 105, 114: n = A,T,C or G
gtanngagaccctgtctctatttattaaaacatattaataaacaaaacaaaaaaaaaagatggctgggcacagnggcccacgactgtaatcctaacattttgggnggcccaggngggtggatcccttgaggtcaggagttcgagaccagcctggccaacaaggtgaaacctcatctctactaaaaatacaaaattagctgggtgtggtggcatatgcctgtaaccgcagctactcaggaggctgaggcaggagaattgcttgaacccagaggcagaggttgcagtgagctgagatcacaccactgcactccagcccgggcaacagagcgagactgtctca

SEQ ID NO: 25189 - DNA, 392 bp, Homo sapiens
  misc_feature 2: n = A,T,C or G
gnataaaaaaccctctaaaccatggcacttgatgtgatgtggcaaggagggcacgtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatgccttgcaaggctgctggaaggcagcttgtggagccgttggttccgccactcattccttctcgtgcactgctttctccttcacagctaagatgccatgtgcaggtggattccatgccgcagacatgaaataaaagctttgcaaaggcac

SEQ ID NO: 25190 - DNA, 498 bp, Homo sapiens
  misc_feature 2, 56, 57, 325, 417, 448, 468: n = A,T,C or G
tnatatgcctataacattctttccttgaagtgtcaggaagttcttttaatttcccnnatttaatttctaaaagtttgaatggtcatcttatggttgtcatgacttatttatatagttctgttcgtggtatcttgtattgactttttttgtggttagggccagaaatgtttttgcagcttattaaatagagttataaaagcagaatctcaagctagaccttttaatcttatactttataggatctttccccaggttgtgctgattcttttaagataataatgtctgtcttattgtgaaaatggacatctcattaaggtaaattggnaaggcccagaaaacatatagaagaaaatgaaaataagttttctattataaaaagaaaaataaatattttggcatatacctgtttttctgggnatatataaaaatctaaaataacacatatgcncttaaaaaggcttactgtgngctggtatggaacctatcctggaaaaaaag

SEQ ID NO: 25191 - DNA, 164 bp, Homo sapiens
  misc_feature 43: n = A,T,C or G
gctgtttagaaacctcaacacacccaatgcgtatcctaaattntggaaactacttagaaaagtaaggcactctcaaaaatgtgttgaacttgcagtacccattacaacagtccttttattgataagaaacgcatgtttaaggatttgaaaatgaagaaggaaga

SEQ ID NO: 25192 - DNA, 498 bp, Homo sapiens
  misc_feature 3, 57: n = A,T,C or G
atnataacccggattacttcttaaggttttgattaagttgatctagcctcaacttanattgtaatacatctgcctaattattgtctggaataacttttcaaccatccaatgcccactgctctcacaatgattattgtagagaagaaaaatggtaattattcaagtaaagtcacataatttctggagtcagtttttcataacaagtttatggaatacatcatcattggcttcttcataatatatttattatgagtgaccaaattttgcctggaggagcagaatgctcaaaacttgttattataggttaatttccagctcactgttgacactgaaagattctgtgttactttaaacccaggataaaaggctggaaaaaaaattaaatgtaagtcataaactagtagtcagcttttcctagttctaaggcttattaacatttgcaaattactcaataaatgctttcataatggaataacataaaagcttttgatttggcag

SEQ ID NO: 25193 - DNA, 322 bp, Homo sapiens
  misc_feature 2, 152, 201, 210, 225, 299: n = A,T,C or G
gncacaaaaccccttatttctgcagtggcatagaatctgttaaaatttaattagaatcacaaatttatctcaagaagctttttaacagttggtgaaatgtgcttgccaacaaagcatcctaacagggtcgttcccatacacatttgacctgntcagccttttccaggtgaatagccccagttctgacataaagaaagtttnatttgtatnttactactgtttggncaattttgatatataactggttacaaacagagccttactatttattagtggggaaatgattttaagaccgactnttcagtatttaattctgcagatc

SEQ ID NO: 25194 - DNA, 500 bp, Homo sapiens
  misc_feature 3, 8, 58, 59: n = A,T,C or G
ganattgnccagccagcgcaggggcttctgctagagggggcaggcggagcttgaggannccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaatccaatagaagggcaatgcttttagattaaaatgaaggtgacttaaacagcttaaagtttaagtttaaaagttgtagggtgattaaaataattgaaggcgatcttttaaaaagagattaaaccgaaggtgattaaaagccttgaaatccatgacgcaggg

SEQ ID NO: 25195 - DNA, 399 bp, Homo sapiens
  misc_feature 2, 59: n = A,T,C or G
gnttgtacacccatcagaggagagatggtgttgggagccctttggagaacgccagtctnccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggagaatagtttaggagaaaccagcttttactgtttttgaaaaattacagcttcaccctgtcaagttaacaaggaatgcctgtccaataaaaggttctccaacttg

SEQ ID NO: 25196 - DNA, 461 bp, Homo sapiens
  misc_feature 4, 16, 27, 37, 39: n = A,T,C or G
cctngcgctatagatntagtaccgcangggaaagatntnaaattataaccaagcataatatagcaaggactaacccctataccttctgcataatgaattaactagaaataactttgcaaggagagccaaagctaagacccccgaaaccagacgaactacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactac

SEQ ID NO: 25197 - DNA, 500 bp, Homo sapiens
  misc_feature 4, 13, 454: n = A,T,C or G
aaancccgtaganggactgactactttgcgcaatgggacattaagttgcattccgtggtcattatttctggatgctaagtccattcagtccaccatctccagctcgcagaattactgaagtttggggtattccttcccccattgatactgtttttactaggtgcaactgtgaaggaaaaactttcttctttaaggattctcaagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaacgacacaggntaggagacgtcgctttgaacgtgctataggaccttctcaaacacac

SEQ ID NO: 25198 - DNA, 122 bp, Homo sapiens
ttgctccaaaagctcagatgggtcaaaaagctccagcccagaaagcacctgctccaaaggcatctggcaagaaagcataagtggcaatcataaaaagtaataaaggttctttttgacctgtt

SEQ ID NO: 25199 - DNA, 466 bp, Homo sapiens
  misc_feature 8, 24, 48, 49, 59, 61, 79, 330, 436, 455: n = A,T,C or G
agaggtgnagaaaatgctgagctngcgcagagggaaaccgtgcctttnnataagagaantnactacatccgtccttggnggaggaaaagaaaaacataaaaagaaacgcctagtacaaagtccaaattcttactttatggatgtaaaatgtcaggttgctacaaagatcaccacggttttcagccatgctcagacagtggtctttgtgtaggttgtcaacagtgttgtgccagcctacaggaggaagggccagactcacagaagggtgttcatttagaagaaagcaacactaatgattcaaacagcttctgaattttaattttgtggtgnctcacagaaagccttatcataaattccataattctaattaatttaccaagataatgtaattacatttgggtttgtaaaggtatcagcagtaatctcctattttggnggcagtttttcaataaagntttgattatgg

SEQ ID NO: 25200 - DNA, 499 bp, Homo sapiens
  misc_feature 14, 46, 61, 62, 109, 154, 250, 254, 405: n = A,T,C or G
tgtcagcgtagggncttctgctgagggggcaggcggagcttgaggnttccgcagataagtnnttttctctttgaaagatagagattaatacaactacttaaaaaatctngtcaataggttactaagatattgcttagcgttaagtttttaacgnaattttaatagcttaagattttaagagaaaatatgaagacttagaagaagtagcatgaggaaggaaaagataaaaggtttctaaaacatgacggangttngagatgaagctcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgnaggtgattaaaataatttggaaggcgatcttttaaaaagagattaacccgaggtgattaaaagaccttgaaatccatgacgcaggggagaattg

SEQ ID NO: 25201 - DNA, 192 bp, Homo sapiens
acaaagcttggtgaacatgatgaagcctcgtttatactacaaatactaaaaattagctaggcatggtggcagggtgccttggattcccagcaacttaaggccagagaatcacttgaacccgggaggtgaaggttgcagtgagccaagatcacaccattgcaccccagcctggcaacaagagcaaaaccccat

SEQ ID NO: 25202 - DNA, 498 bp, Homo sapiens
  misc_feature 2, 60: n = A,T,C or G
gntagagattccacaactacttaaaaaatatagtcaataggttactaagatattgctttncgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaaggcaatgcttttagattaaaatgaaggtgacttaaacagcttaaagtttagtttaaaagttgtaggtgattaaaataatttgaaggccgatcttttaaaaagagattaaaccgaaggtgattaaaagccttgaaatccatgacgcagggagaattgcgtcatttaaagcctagttacgcatttactaaacgcagacgaaaatggaaaggattaattgggagtggtaggatgaaac

SEQ ID NO: 25203 - DNA, 500 bp, Homo sapiens
  misc_feature 8, 22, 27, 44: n = A,T,C or G
gaatactnaggtgtgcttaggngtgcnaaagggaaggagacctnaattcaccaagttaaatcttgctaaaccttatcataagcattttttgagcgcttagcatacaccaagccttgtggaaggtgctttcctgccatatctcatttaatcctcacagcaaacctatagaatatggcattatcatctgagtctcacagaagtttagtcgtgtactcaaggtcttaccagctagtgaacagcagaccaagactggaaacccaggatagtctgatacctgagccatctcttcttgtgctacgcctagttattctgtccccaaatcaaaaggcatgacctttataagaggcgctttactgacaatagctgcaattttaactttgaaaatgattcagaattatcaaagatagtaagattcgaatgacatgattgctataatctcgctagccttgacctgtgtgtgcatagcaattacagggaagtaatctagctcctgactatta

SEQ ID NO: 25204 - DNA, 125 bp, Homo sapiens
  misc_feature 20, 94: n = A,T,C or G
tctggaattagacctacatnctaacctggctctgatatgcttaagccctgctaccttggggaggtgtgcacttcaccgattttagctacagctntcctctccttatatactgggcatttaatgac

SEQ ID NO: 25205 - DNA, 436 bp, Homo sapiens
  misc_feature 2, 14, 60: n = A,T,C or G
gnttacaagtcccnaagtaaaataagtgttggagtaacacttgcataaaagaatttaagnagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgctgagaaagtgaaagattgtgtatttctattaaaacatttacaatct

SEQ ID NO: 25206 - DNA, 463 bp, Homo sapiens
  misc_feature 58: n = A,T,C or G
gcaaaaaatccctaaagtctatgagatacttaggtagtgagtacagtatgagaagtgnttccctgtggatacaatagcaaaagttttctataagtgttgaagtctgtcctggattttgaaagattagtagttttggaaggtggaatggccctggaaggtagatacactttcggagttctttattaaacacaaaggaaacaccaacagtgatgtccacttagagaggaaaactgcctgttccttaacaaattaaacaaatttgttaattcaacaaataacctttgtaacagtagggatttttaaacttgtaaagttttaaaagttttaaattttgaaaacttcaaaaataattttattcagggctgttttatttgtacttcataagttgcatttctgctcaaactttttttactactgtggttactaccctcttactggtctgagtttctttgctgcattcatc

SEQ ID NO: 25207 - DNA, 282 bp, Homo sapiens
  misc_feature 1, 4, 45, 57: n = A,T,C or G
naanagttccacagttgtgttcttttctggagcagtactcagcancctgcatgtagnaatgtagaaggtaagtggttggattgatcctagttctgctattatatagagaaaaccaaggctgaggtcattttagtgacttcacaaatgtagagaagtcagctgggcagggtaactcaccctgtaatccaagcactttgggaggctgaggcggaaggattgcttgagcccagcagttcgagaccagtctgagcaacatagtgagactctgtctctactgaaaat

SEQ ID NO: 25208 - DNA, 443 bp, Homo sapiens
  misc_feature 4, 13, 29, 328, 361, 364, 374, 396: n = A,T,C or G
cccngaagaggcncatataatgaataaantgggaaatttaactacaggttgaggaataattaaaaagttaagaaaatactttgaacagctttataccagtgcatttgaaagctttaacgaatttaaattcctagaaaaatataactcaccagactaactcaagaagaaatagaaagcctgaataattttttaaccattaaataaattatttaaaatctacctattaaaaaaaaaagcccaggcctaaataatgctatggccaacttccagcaaacgttccagggacaagatcatttcaatgttaaattatgccagggagataaaatgngtgatttcttcacaggtcatttttttaagaccnctnttaccttggnaaccaaaccaggcaagggtggngccagaaaaaaaattaccagccagtctctctcatggacccaggatgc

SEQ ID NO: 25209 - DNA, 498 bp, Homo sapiens
  misc_feature 1, 7, 29, 50, 418, 461: n = A,T,C or G
nccgagnattttcagcaccataatatttntgtaccagggagattatagtnttctaatttttttagggaaaaattgcttagctctagggatttctaaactttgaacaataaaagttaattttagaaatactttcagggtcatcattaagctttagcgtggctttgttactgccctgttaagtagttttgttggttagtatggacagtacagcaaacccattatgattcctttacagtgagaaaaatatgaaatagtccagaaagaataagatattaagtaacctttgcctgaaggtctgtgaactccttaagcgtttgaatgtaaatacttctccccaccccgaataagccgtattcttctgggaaaaggcaatgaaaaaagaaatgaactttcttctcagaccttggaaagttttagngcatagtataatttttttcatatgatagactgagctttatgcnccccaggtggactgggtgggtatggatcaggagacag

SEQ ID NO: 25210 - DNA, 299 bp, Homo sapiens
  misc_feature 2, 5: n = A,T,C or G
gngancaacctggagttatgcagccacaagccatggaatgcctagagcaaacagaatctggaagagtcgagaaagaattctcccctacgtacttggagagagtctggtcctgccaacaacttgatttggggcttctggtcaccaaaagtatgtgagaataaatttttgttgttttgaactaccaaatctgtggtcatctgtgacagcatccacaggaaactaacacctcccctccaaaggattgttactaattgcaagaaaacagtttacatcagcctgggctgacccaggcctgctgg

SEQ ID NO: 25211 - DNA, 303 bp, Homo sapiens
taattacaggtctttgtatttaaatcgatcagccataatgattactgcttttatgaagatttatgccaaaggtagctcccttactgtgggacataaaagttgcttgttttcagctttgaccagtgatgaactgataaccctggtaggaaaatgaaacattggggctgggcttgtaatacgctttcttaaaagaatgccccattgaaattagagtggcacggtgccaccagaccaagggttctcatcccgatgccacagagggccacaggtgttatgaaagtggtttgcaaaattgaatgtatg

SEQ ID NO: 25212 - DNA, 252 bp, Homo sapiens
  misc_feature 4, 8: n = A,T,C or G
taanagtnccgactaggagtcctaagaaatgttctgttcttgtacattatactgatttagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagc

SEQ ID NO: 25213 - DNA, 345 bp, Homo sapiens
  misc_feature 1, 53, 55, 335: n = A,T,C or G
naaactcccgcaaagggaacgtcatcgttggaaagcgtcgaataagacgcacncnttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggnttttaaaaat

SEQ ID NO: 25214 - DNA, 317 bp, Homo sapiens
  misc_feature 4: n = A,T,C or G
cagnagtgatgttgcaatatctggaactagcaaaggatactgatgagaaaacgtggaatcatgtgggatgtgacctcctaggactcaccttgcacagctgggtgcagcagggataggtaaggatttggggtttagaggtacaattgcctttttatggttagagaaaggtcctggggctggagggagcctgacgatctgctctgtgtgcaaggggagagttaactctgcacgcaagagcctgcttaaagggctgtgtcagttctattgtaaacaccaacttaaagtggtggatgctggcagacattgttattgccatt

SEQ ID NO: 25215 - DNA, 361 bp, Homo sapiens
  misc_feature 1, 12, 58: n = A,T,C or G
nataaggccccnacaccagtaaagcttctcttctctggaaaaagtttaggtctctgangttttctcagtgcatcataactgacagcagcaggaatgtggttttgctaaaggcaacagaaaagcaaaactgtctcaagatttaaatattaatccaaaggttgaactttttaccttaatgttgctgctttctgtatgcacatcccacaggatgtaggaaggtggaaaggatgaaggaatgtggaaaatgtagaaaattagaaaataaggtaaatttaaaaggtaatacgactaacattcattcattcacattaagctcctaccttgtccacattgtattgtagacactgcggatatagcagtg

SEQ ID NO: 25216 - DNA, 161 bp, Homo sapiens
  misc_feature 7: n = A,T,C or G
taatgangcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcaga

SEQ ID NO: 25217 - DNA, 497 bp, Homo sapiens
  misc_feature 44, 45, 46, 460: n = A,T,C or G
ccagcgcaggggcttctgctgagggggcaggcggagcttgaggnnnccgcagataagtttttttctctttgaaagatagagattaatacaactacttaaaaaatatagtcaataggctactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaccgaaggtgattnaaaagccttgaaatccatgacgcagggagaattgcgt

SEQ ID NO: 25218 - DNA, 476 bp, Homo sapiens
  misc_feature 8, 14, 29, 30, 334, 470: n = A,T,C or G
tatggcangaacangccgccttacgaatnncggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgctaacttccatggcatggatcttacccgtgcaaaatgtgttccatggncaaaaaatggcaaacaatgattgaagctcacgttgatgtcaagactaccgatgggtacttgcttcgctgtctgggttggtttactaaaaacgcacaatcagatacggaagactttatctcagcaccacagtccgcnaatccg

SEQ ID NO: 25219 - DNA, 495 bp, Homo sapiens
  misc_feature 1, 10, 57, 419, 436, 459, 473, 495: n = A,T,C or G
naaagaaccngttcctccaagacctattctgaaacagaaatgttctagcctagagantctaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccacgcttctcaaagaattgctttcttggaaagttttgagcccagaagactattcaacctgtttttctagcagaaattttctaaatgaagcagtggactatgttattcgccacttgattcaagaaaataacngagtaaaggccagaatntttctgcatgttttgagtgagcntaaagaagtggagnccaaattagccgcctggatccn

SEQ ID NO: 25220 - DNA, 427 bp, Homo sapiens
  misc_feature 3, 13, 43: n = A,T,C or G
ganactgcttatncagctttggaggaaaccagctcaacaattnaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgatgatgaatcaagtagtgatgaaaccagtaatcagcccagtcctgcctttagacgacgccgtgctaggaagaagaccggttctgcttcagaatctgaagaccggctagttggtgacaagaaactgaacctctaaggagttgagtaaaccgcagtcagta

SEQ ID NO: 25221 - DNA, 497 bp, Homo sapiens
  misc_feature 2, 56, 462: n = A,T,C or G
antgtcccataagatattcgctctggagaagttacatgtaaatagaattctatatnttgttttccagttgaccgagtatctgttgtgtttttgtttaaaaagaggattccatgacataataaaaattattttaaaaaagtgctgggattgcaggcttgagccaccacactcagccttattcttatattttaatttggtcattcttagatctacagattgaacatccctaattgaaaactttttgagtactaacatagtgttcaaaggaaatgcttattggagcatttagaatttcagattttcagattaggggatgctgactggtgtaatgcccagtattccaaaatccaaaataatttgaaatctgaaacacttaatggtcccagcatgttgggataagggatactcaacctgtattgatttttctccactataattcaggtctataagttcttccctatnaaaaatgaatgaattaggaaattgataataaacat

SEQ ID NO: 25222 - DNA, 149 bp, Homo sapiens
  misc_feature 41: n = A,T,C or G
attgtattcaaacggtgttgcaactcacaagtaaaggaatngtctgagcaagaaggtgctaagaatgatgtgaaagattctgacacgtgtgtatcagagagcaatgataattcaagaacaacagctacagtttcacaaaaggaagttga

SEQ ID NO: 25223 - DNA, 189 bp, Homo sapiens
  misc_feature 18, 47, 57, 60: n = A,T,C or G
tatattagatgacagtanagaatgtattaatcttgttagatgtgatnttaacagggnggntatgttaaaaaacaaaaaacaaaaaacaagatgaccttatcagttagagacatctaattgaagaatttatagaagaaatgacattatgtataagatttgactttaaatactccagcaaaagaaatatgg

SEQ ID NO: 25224 - DNA, 213 bp, Homo sapiens
  misc_feature 20: n = A,T,C or G
acaccccgacttaagcctgngtgacagagtgaaaccttgtctcaaaaataaattcataaataaaaaaagttagctaggtgtggtgggcacatgcctgtagtcccagctgctcaggaggcaggaggctgtgcaggagtgttgcttgagcccaggagtttgaggtgcagtgcctgtgattgtgccatgcactccagcctggtagacctggctcgc

SEQ ID NO: 25225 - DNA, 497 bp, Homo sapiens
  misc_feature 10, 57, 58, 478, 479: n = A,T,C or G
aacaaagccnggaggtcttgtaccaatttctgccctatggtagatagtgaggcttcnnacctataatctaagcatagtatatcagttagttagaatacaattaactaaagacatcgctagctaatagtgaggcttcccacctataatctaagcataatatgttaatttagctaatgcaattaactaaagacatcgctagctaataaacatgtaaaagcaataacattacgtgtatttagcattttagagtttggaagtaatttctcacaagtcttagtaccccaactttggaagggaggcactattaccttcattttataaataaggatgaagatgcctggggaggcaagaattacttggctataaagtcaaagctgggaatggactcaagtcttttgtgagttgtaagcagggctgtgtggtcaaacacagctacaggttagttatgatttcaacacttactggttgagtaccttgnnaggcaagtcacttttctg

SEQ ID NO: 25226 - DNA, 430 bp, Homo sapiens
  misc_feature 1, 57, 59, 367: n = A,T,C or G
ntattccgccgacgttgtctgcaggcactcagaatggtccagcgtttgacataccgncntaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttccgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcncagagtcagaaagctaaataaaaaaatgaaacttttttgagtaataaaaatgaaaagacgctg

SEQ ID NO: 25227 - DNA, 275 bp, Homo sapiens
  misc_feature 2, 6: n = A,T,C or G
gntagngtgccccttttggagggggaagtttatttttatatttaaagaaacaaagactttcagttcaagggggagaagaaatgaaacaaagtttgcagtgggctttgaaaacttggactgcattatgcaaaaagcacagctgtaataccagggccaggaaaaaagaccaaactcctgaaatatttgtgctgctcgccttcactgtgctaatgattctagcagtttaaaaatggacttcttgtttatcagcagccactgccaaattaatagtttac

SEQ ID NO: 25228 - DNA, 233 bp, Homo sapiens
  misc_feature 1, 10, 58: n = A,T,C or G
nataagaccnaatacgaactgaaagttaaaatgctggcaagatgaagttaaaaggtanagtttttatcagtttttctctttgtttgtttgtttttgcaatcatagttaagttgtcatcagtttaaaatagtggattatatgatgttacttgcaagcctcatgagaaccacaaatcaaaaagcctaccacagatagacaaaaaataaaaagcaagaaattaaaacatatcacca

SEQ ID NO: 25229 - DNA, 380 bp, Homo sapiens
  misc_feature 1, 56, 355, 373, 380: n = A,T,C or G
naaaagcccacattcttaagttattcttaagttattcctttacattcttaatgttntcctttacattcttaagttattaagttattgaggatcccaaagagtttttgtttatgtgaattatagctatcgatatttagtcagaaattaaaactgagtaattgctaaaatattgttgtaaaataagacacaaatacaaatgtatttcagtagaagcacaaggaaaacgtttaaggatttaaaatgactgtattggacaataatgaggttatagatacacagacatcaccgcaaatagaaccaacgatagcacagtcaaggaactgagagctaattgagttaatctcaaaactcttgngtttatttaaactcttgnatttatn

SEQ ID NO: 25230 - DNA, 202 bp, Homo sapiens
  misc_feature 6, 28, 117, 162: n = A,T,C or G
gcgttncctgcacaaaatgcccggctgnagctgcagaaaccgtccctgtttcagagcaggagttgccagcagccccaggctgagacagggtctggaacagaatctgacagtgatgantcagtaccagagcttgaagaacaggattccacccaggcaaccacncaacaagcccagctggcggcagcagctgaaattgatgaag

SEQ ID NO: 25231 - DNA, 497 bp, Homo sapiens
  misc_feature 8, 58: n = A,T,C or G
acaaaggnccatttgtaaagaagctccttccagcacctcctctcttctccttttgccntaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaaccgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgccaaaagacgttttctttggccaaagatctctttcgtgattccttgcaacaatcaatgagaatcttcatgtattctggagaacaccattcctgatttccacaaactgcactacatcagta

SEQ ID NO: 25232 - DNA, 390 bp, Homo sapiens
  misc_feature 3: n = A,T,C or G
cangaagacccgtgacatctccctgcaattcttcttgcctttctcacttggcaaggattatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactgccctgccgactgaccattgctccaatttgtctataaggattgcagcctataaatcgattctacaggagagagttaaaaagacttggcagttgtggatgcaaaaacccc

SEQ ID NO: 25233 - DNA, 470 bp, Homo sapiens
  misc_feature 4, 59, 408: n = A,T,C or G
aaangtggcccctcagctatatcactgcccaacatcagaaaacctgacggctatgattnctatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttggtattgtttacagaccatttaattaatatttcctctggttattcctcctctcctccattnatggctcacacctgttaaaggaaaaaagaatcaaattgaatatatcttttaagaattcaaac

SEQ ID NO: 25234 - DNA, 496 bp, Homo sapiens
  misc_feature 394, 405, 448, 474, 487: n = A,T,C or G
aattcacccaaaaccttaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttaagagaatgatttccacctttatgttttaatatcctangcatctgctgnaataatattttaagaaaatggttggaatttaagaaatacttgngtactaatttgtatacccatatctgngccatggaatatnaatatcaca

SEQ ID NO: 25235 - DNA, 498 bp, Homo sapiens
  misc_feature 5, 25, 60, 418, 456: n = A,T,C or G
aaaancttcctgataaaaacccgantaacccaaatgcacatggcgattttttaaaaattnatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgtcacattgccatgatttagctcccacatggagagactttgctaaagaagtggatgggttacttcgaattggagctgttactgtggtgatgatagaatgctttgccgaatgaaaggagcaacagctntccagtctcttcatttttcggctggaatggcccagtgnaatatcatggagacagatcaaaggagagttagtgagtttgca

SEQ ID NO: 25236 - DNA, 270 bp, Homo sapiens
  misc_feature 55: n = A,T,C or G
aaagtgcccacgcctgtaatcccagcactttgggaggccggggtgggtggattgntaggtcaggagttcgagaacagcctggccaacgtggtgaaaccccttctctgttaaaaatacaaaaattacctgggtatgctggcatatgcctgtaattctagctactcagggaggctgaggcaggagaatcgcttgaacccaggaaacggaggttgcaagtgagccgagatcacaccactgcactccagcctgggtgacagagggagactctgt

SEQ ID NO: 25237 - DNA, 498 bp, Homo sapiens
  misc_feature 6, 11, 26, 61: n = A,T,C or G
ctcccnaactncaaactccaaactanttgaagtaaatccaaagagtgaagttgcaggtggngctagaaggagaaacacctcatatgcttctcaggccccatgtgttcatgcctgaagttactcccgacatggattacttaccgagagtacccagtcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccggctcgcagaattactgaagtttggggtattccttcccccattgatactgttttactaggtgcaactgtgaaggaaaaactttcttctttaaaggatctcaagtactggcggtttaccaatgatataaaagatgcagggtccccaaaccaatttcaaaggattgggaggactaactggacaaataggtgca

SEQ ID NO: 25238 - DNA, 498 bp, Homo sapiens
  misc_feature 5, 13, 30, 44, 73, 91, 104, 110, 119, 142, 167, 173, 222,230, 264, 441, 461, 469, 491: n = A,T,C or G
aacgngcactgtntattgagtgataaaatntgctactatggatnaatgcatagaacagtgcctgctacatagnacgatctgtgatttatantattattagtaanactgcntgccatgcnctatgcttgaattctcaaaatanccctatgaggtagattattgttatnatcccngttctaccttcgaagacattaagacataatgagggtaaatagttcttgngtcatgtngtaagtgaaatctgcgatttgggacccttttggnacttgctactgctaactacatatccccagcttcaagggggcagagatggagaaagccttggtattgggtaaacattagtaatgtccacatatactcctaccacaaggggatgaaattggcctgtgcactgtacctttctagtcctgggtatcacagatgctacaattttaaattggngaaaaataggatttcaatgnaaattggnaattattaataataagggtatncatgtat

SEQ ID NO: 25239 - DNA, 498 bp, Homo sapiens
  misc_feature 2, 3, 58, 329, 401, 423, 456, 471: n = A,T,C or G
gnnaagaacccctgcaatgaaaaggaaggggctcagttcagcagtcatcttatcaatnttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagnacaagacctagaagccacttttagacttcttgtggctcttggaacacttatcagtgatgattcaaatgctgnacaattagccaagtctttaggnggttgattctcaaataaaaaagtattcctcagnatcaagaaccagctnaagtaagtgaatgccggtagatttatc

SEQ ID NO: 25240 - DNA, 427 bp, Homo sapiens
  misc_feature 8, 11, 58: n = A,T,C or G
gaactttnccnaatctgagaaaaacaagcaatggggaaaggattccctatttaataantggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaagacttcatgtccaaaacaccaaaagcaatggcaacaaaagacaaaattgacaaatggaatctaattaaactaaagagcttctgcacagcaaaagaaactaccatcagagtcaacaggcacctacaaaattggagaaaatttttgcacctactcatctgacaaagggctaatcccagaatctacaatgactcaaac

SEQ ID NO: 25241 - DNA, 499 bp, Homo sapiens
  misc_feature 4, 28, 33, 46, 384, 454, 477, 488: n = A,T,C or G
tatngcaggtctttatttcttatgtaanacagnaggtaacttttcntaggtttcactctttttagtgtactagatccagaaacttagtgtaatgccctgctttatatttctttgacttaacattggtttcagaaagaatcttagctacctagaatttacagtctctgtttcatggcaacactggataatggctttgtgaaatttaaaaaatttttgtagcgactgtaaacagaaatgccaaattgatggttaattgttgctgcttcaaaaataagtataaaattaatatgtaaggaagcccattctttcatgttaaatacttggggtgggaggggagaaagggaccctttcttaaaatgaaaataattactgctattttaaaanttcttgacattgaatgtgagaccctctacatgatttgagaagctgaccaagtataggcagaggtattttnccggttacatttttttttggttnggggaaaaatnggagggggcta

SEQ ID NO: 25242 - DNA, 418 bp, Homo sapiens
  misc_feature 3, 5, 355: n = A,T,C or G
ctntntgattcttcagaggctcttcaggttctcctctgtcattcggtcagccgtctcagtccatttgcggaggaacattggtgttacagcagtggcatttaataaggaacttgatcctatacagaaactctttgtggcaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggnaatttgcacggattagttgtcaactagttagaagtttcagaataaacatgcatttcataactg

SEQ ID NO: 25243 - DNA, 497 bp, Homo sapiens
  misc_feature 58: n = A,T,C or G
atatgccaccatctacaaatcattgattataaaaatcaaagatctacataaatggtanttcatggagtgctcatggattggaagataccgatgatttctaagtaagaataaagtctttgaaaatagtttcaatgcaattcaaatcaaaaccccagcagacttttttcttctttttcttttttgagacagagtctggctctattgcccaggctggagtgcatgacccaaacataattcactgcagacccgacttccagggttcgggtgatcctcctgccttaagccttaatttttttcttatagatgtcagtaagcttattctaaagtttatgtgcaaagatgaaagaactagagtttcaaaattaattttgaagaaaaacaaagtttgactactcactacccaatatcaaaatttaatataaaactacagtaatcaaggcaatccagtgtaaggtaatgattacatacacattaattgaacaaaatagagagctcag

SEQ ID NO: 25244 - DNA, 471 bp, Homo sapiens
  misc_feature 60, 460: n = A,T,C or G
taaagaaacccttttgtgtttctctatatttttacgttgtctgcaataaataggaaagancctaatttatttatttacttatttatatttttcgagatggagtctcactctgtaacccatgctggagtgcaaagacacaatctcaattcactgcaacctctgcctcctgggttcaagcgattctcctgcctctgctttctaagtagctggaattacaggggcgcaccaccaggcccggctaattttttttgtatttttagtagagacggagtatcaccatgttggcccagctggtctcgaactccttacgagtgatctgcctgctcagccttccaaagtgctgggattacaggcgtgagccactgcgcccagcccatgaattcaatctaaacaaataaaaaccttaaatccctcaaaatctacttccttacattgaattgtctgagaagaaaatgcaggntcttgttactg

SEQ ID NO: 25245 - DNA, 456 bp, Homo sapiens
  misc_feature 11, 12, 431: n = A,T,C or G
aaggagctccnntatgaggacgcaaaggcatgagaatgatacaatggactttggggactctggggaaaggacgggaggcgggtgagggataaaaaactacacactgggtccgagcacggtggctcatgcctataatcccagcactttgggaggccaaggcaggtagattatgaggtcgggagttcgaaaccagcctggccaacaaggtgagaccccccccatctctactaaaataattagccgggcccggtggcgcatccctgtaatcccagctactttacttgggaggctgaggcaggagaattgcttgaactcgggaggcggatgttgcagtgagccaatatcgcaccactgcactccagcctgggcaacagagcaagactccgtctcgaaaaaaaaaataaattttaaaaactacacattgggtacantgtacactcctcgggtgatgggggc

SEQ ID NO: 25246 - DNA, 411 bp, Homo sapiens
  misc_feature 2, 5, 59: n = A,T,C or G
gntantgaccggaaagtttacccatgaagattggtgggattttttgtttgtttgttttnttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatcaaatgtctatcaactttaatcaagttgtaacttatattgaagacaatttgatacataataaaaaattat

SEQ ID NO: 25247 - DNA, 500 bp, Homo sapiens
  misc_feature 2, 3, 56: n = A,T,C or G
annagcccatgcttccagtcaatgaaggcaagaagctgaaagaaaagctcaagccnctgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctatggctgcaaatacttgcttaaactatttgacattttctatctttgtgttaacagtggcacagcaaggctttcctacataagtataataatgtgagaatgatttggttttaattataaactggggctaaatcctaaagcaaaattgaaactccaagatgcaaagccagagtggcattttgctactctgtctcatgcctt

SEQ ID NO: 25248 - DNA, 360 bp, Homo sapiens
gataaagtccaatggaacacagccatccatgcttatgtaagtgtgcatattctctggctgttttcactgcaatagcagagttgagtagttgtgacaaagagtttatggcccacaaaacctaaaatatttactttctgatgctttacagaaaaagtttcctgaaccttattctagctatatgttgttcataaatgaatctttcgtggttctgaaggcatttaagaatctcttaggttataaattggctgggcgcagtggctcacgcctgtaatcccagcactttgggaggccgaggctggtggatcacgagggcaggagttcaggatcagcctgccaagatggtgaaaccctgtctccatt

SEQ ID NO: 25249 - DNA, 362 bp, Homo sapiens
  misc_feature 2: n = A,T,C or G
gncatgaagaccaaagtatgataggtcatcttcaagaggagcttgaagaaaaaaacaagatttattccttgatagtagcccagcatgtgggaaaaagaaggagggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacataggagttgaaatggaaggagttgccctcaaaatatgaaaaattacagggctttacaacagatggatggaagaaataaacccacagaacttttggaagaaaacactgaag

SEQ ID NO: 25250 - DNA, 500 bp, Homo sapiens
  misc_feature 2: n = A,T,C or G
gnctacgttccctgctaacgtcacaaagtatcttcacaagtttaacggagtctatcagtgctgctcatgtgaaatcaagtaggaactgctaaggaacattcaaataaggttaaagacacagagtaaattaagtgcctaaaaacaaatgtgatacaaattagagtttgtgtctttgcccttatccatttacagaatttaccccattaacagctggaaatttattttcactttcttcacctctctaagaggaaagcaaacatataacacagccccaaaggagtaattaattagatcatttactgacatggatttgaatagtttatttaaatcaattctgttatttatttattttacaacattatgcaagaggttgaaactcctgttccaatttgcacttagcaagaatctctgaaaaaatatcacagtgaaggaaataaacaaagaccaggatcaaagggccacattcagaaacgcataaaagaatttcaccaggacgtgtg

SEQ ID NO: 25251 - DNA, 370 bp, Homo sapiens
  misc_feature 7, 8, 326: n = A,T,C or G
ctagtcnntatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttgccaagtggttgtcatttgttaaaccctggtttacctgtcttgctattatgacatttcatttggaaggntgtttgtgttgtagctaactggtcaagtctggtgctgactgctg

SEQ ID NO: 25252 - DNA, 382 bp, Homo sapiens
  misc_feature 6, 9, 56, 58: n = A,T,C or G
gataanccntaactagaaataactttgcaaggagagccaaagctaagacccccgantncagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatc

SEQ ID NO: 25253 - DNA, 279 bp, Homo sapiens
  misc_feature 175, 215, 269: n = A,T,C or G
taatcccagctactgtaatctcagctactcgggaggctgaggcaggagaattgcctcaaccgggaggcggaggttgcagtgagccaagatcgcaccactgcactccagcctggcaacagagcgagactctgtctcagaaaaaaaaaaacaaaaaccagtttaggctgggtatggnggctcaccagcactttgggaggctgaggcaggtggatctnttgaggtcgggagtttgagaccagcctggccaacatggggaaaccctgtctttnctaaaatttt

SEQ ID NO: 25254 - DNA, 498 bp, Homo sapiens
  misc_feature 13, 57: n = A,T,C or G
taaaaaccccctngcacaacatcagagagttcatactggagagaaaccttacaagtntaatgaatgtggcaaggtttttaatcaaaaagcaagccttgcaaaacatcagagagttcatactgcagagaaaccttacaagtgtaatgagtgtggcaaagcctttactggacagtcaacacttattcaccatcaagcaatccatgggtgtagggaaactttacaaatgtaatgattgtcacaaagtcttcagtaatgctacaaccattgcaaatcattacagaatccatattgaagagagatctacaagtgtaataaatgtggcaaatttttcagacatcattcataacttgtagttcctcagtgaactcatactggagagaaaccttacaaatatcatgactgtgacaaggtcttcagtcaagcttcatcctatgcaaaacatagaattcatacaggagagaaacctcacaagtgtgatgattgtggcaaagcctttac

SEQ ID NO: 25255 - DNA, 345 bp, Homo sapiens
  misc_feature 11, 20, 46, 151, 152, 339: n = A,T,C or G
cgattcggtcngacgagctncgctttcgctacagcatggtggcctnttggagacaggctggactcagctacatccgatactcccagatctgtgcaaaagcagtgagagatgcactgaagacagaattcaaagcaaatgctgagaagacttnnggcagcaacggtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgctggtcataaatggcaatgcaataaattgaaatatggntcactg

SEQ ID NO: 25256 - DNA, 497 bp, Homo sapiens
ataagattatcttaaagctgaagccaaaatatgcttcaaaagaagattctttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgctttatgcagacacaaggaatt

SEQ ID NO: 25257 - DNA, 125 bp, Homo sapiens
ctctgaacaaggggttaggaaatctagagagacataagcagcagaagtcgaaagaaaactcattagtttaaataatcaatgttctttctattacattaagtaaaaatagaaactggtcagtgaat

SEQ ID NO: 25258 - DNA, 410 bp, Homo sapiens
  misc_feature 2, 19, 30, 34: n = A,T,C or G
tnagaaatgaagggagggncaacaatctgntttngtgtctcctcagaaacaatcggcccagaaggttatatttaaaaagaaagtttctcttttgaatattgccacaagaataatgggcggtggggaatctggaacagtgtcttctcagaaacaaccagcctcaaagactgcaagtgacaagacaagattctgctttgaatacagctacagaaataaaggatggactacaatgtgggacagtgtcttctcagaaacaacaagccttgaaggctacaactgacgaggaaggtctgtttctaatatagccacagaaataaaggatggagaaaaatctgggacagtgcttctcagaaaaaaccagccttgaaggccacaagtgatgagaaagattctttttcgaatataaccag

SEQ ID NO: 25259 - DNA, 247 bp, Homo sapiens
  misc_feature 7, 11: n = A,T,C or G
caatganaccnaaattgaggagatccaactgaaagaggcaaagcacattgctgaagatttcgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagcaaatgtgccgagcttgaaga

SEQ ID NO: 25260 - DNA, 236 bp, Homo sapiens
  misc_feature 7, 10, 45: n = A,T,C or G
caggagncgngtgaccaccctcaacacggatatcagcatcctgtntttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttt

SEQ ID NO: 25261 - DNA, 421 bp, Homo sapiens
  misc_feature 51, 418: n = A,T,C or G
cgaactcagtctcttactgttcaaagaaagaatcttaacagttgaattttngagggaaattcccttttgccccaagcgtttctatatttaaagcaatatcccaggagaatatgttagacttaggatgataccttcagccacttgaagaagaaatagaaggcgctcattccaatatagtctttatttcccattcagatacaggttgagcatccctaatctgaacagttaaaacccccaaatgccccaaaatccaaaccttcctgaacgctatgacaccatgagtggaaaattccacacctaacaaacacatttgctttcttatggttcaatgtacacaaactgttttatatagaaaatgatttcaaatatcataaaattaccttcaggctatgtgcataaagtatatatgagccatagntgc

SEQ ID NO: 25262 - DNA, 437 bp, Homo sapiens
  misc_feature 55: n = A,T,C or G
aatgacccataattggaactcttcagccaagccatatctaacagaactatcttcntcttttcaggtatgtgagaatacattcccttctcactttacaccaatttgggttggattttatgtcacttgtaaccaatggatccttactgaatcaaatactaaattatttgaggatagatccataaacaaatacatataggaatgagtgaatataaatgtacttctggggcaaacctaactaaaatggaagtggtagactgaggagtggttcacagagtagaagagaactaggctggggcaaggagcttgaaattcaagtcagggctaggcacagtggctcacgcatgtaatcccagcactctgagaagccggggcaggtggatcacttgagcccaggagttcaagaccagcctggcaacatggcaaaaacctgtctctac

SEQ ID NO: 25263 - DNA, 498 bp, Homo sapiens
  misc_feature 6, 13, 39, 40, 490: n = A,T,C or G
aagctnacaatgnactgtatgaattaagtgacgctttanntttgattttacattttaaagttaaaatgtgggcattatgtcagcaaacttaagggcattatgtcagcaagctaaaacattttttttcctgtgcttttaatgtatctctttacatgatctgagagaggatcaagttgatagaaatagctgaggggaaaagggggaacatcttgggatgaagcttgccttatggtgatggtttaattacagattaaaaaattagaaggaaatttcagtgaattaagtgtatagctttcatatctacatttcaagaaattaccattgtaacttgataagagatgatttattttatgtaaacatctttgcaaagcaaggtgtagcagctcagctagatttattactgtgcacgaaagtaaatacctatctcaattattctttttcttttccaatataaagtttgctgaatgtccaagaagagtttatcacttanggatatag

SEQ ID NO: 25264 - DNA, 437 bp, Homo sapiens
  misc_feature 10, 12, 45, 265, 275, 371, 403: n = A,T,C or G
caagcggaanangaccaccaggaagcacaggtccaaggctggccnacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgncattcgtggntgatttcaatacactcaagtgccattcatcctttaagaaaaacatctggatatcaaggtggaaatggccatttaatgattgaatatatcattttgnggatataggtattaactttttgaattctatgngggattaacaataaaagcattttgcaaacactgg

SEQ ID NO: 25265 - DNA, 500 bp, Homo sapiens
  misc_feature 10, 11, 47, 50: n = A,T,C or G
cttaagcggnngtgagtcttttcaagcaacccggccagtactggganttncagccatccaccttcagatgtgtctacgtgcgctctgcattcaactcggaaactataagtaattctcaagggaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagctttctttttaatttccaggaaaaaataaaaagagtatgagtcttctgtaatcattgagcaggtagctcatttgagataaagtca

SEQ ID NO: 25266 - DNA, 495 bp, Homo sapiens
  misc_feature 11, 57, 59, 60: n = A,T,C or G
aaaaaaacccntctggcttccttaataagatagttgagcctatgacattaaggagcntnnctgctggcggaagattctagattcactggtggtttaagaggcccagggatttagttcttactggtgcgtaagtgttttcccatcctaaccggaaaaccactcacccaggcttcccccacttcccctcaaattttctcagctctgccgctggtctccatgaacggcaaggggaaccaccactcattcactgtcagtgtaggtaagacagaggatgcccttgcaaaaattgggactgaggacagtagcacacggaatggtggatcgtacatttgcacccagagctactaaacgctcagtgaccccagagaccattaatttcccggagtgaaggggatgggggtagagctaattggaatttttattatccaggactcatcctaagaagaatgttggcctctcttcatcccttggcttagccgcaggtaagaacgctta

SEQ ID NO: 25267 - DNA, 489 bp, Homo sapiens
  misc_feature 1, 61: n = A,T,C or G
nagatggatccatagatagatacataggacatctatagagatatatgtttctatataaatntatatctatattatcctaaagaaatatatatttgaacaaaatctatttatgaaaatgttcactaatgcaaaacttataatggcaaatagaaagggaatccgctgaacaaaatattatcaatcccaaataatgagatattgccaaaacactatatttaaagaacttaagtgatttgggaaaatattatcttgtgagggcaaatacattaaatttgtatattcagtattgccaaatttatataaaaaaatgggtagaatttctttttaaaaaacaccttaaaatataaacggagtaattcccaataatcagattacatgtgattttattttcccccctaattttaattttcaagttccgtacaatgaacatgtgttattttcataagtataaaagacttttttataaaaagaaatatatagactaattag

SEQ ID NO: 25268 - DNA, 500 bp, Homo sapiens
  misc_feature 15, 30, 45, 54, 61, 67, 69, 76, 80, 328, 361, 443, 483: n = A,T,C or G
ctatgaccaacatanataaaaacacgagcntagcattatccattnccaaagttncattacnccgacncntccaaanaggngctaagcaaaaacccccaatgtattattgaaccatggacttgcacctcatgtttaatgtgaatatttatttccatgtccctcttaactggttttttcttgcttccccctagctgtattgttatttcagatatgtgatatctgttttcatactcttgcctttccatcatgaatgcttaagttatgaacagagatcctttgtagagctcataggcagtacagagaggtaagcttgcctcagagggcttgnatcttggtgtagtttttaaatagtgcatagtgnatagtggacattttggtttgcacatagtttggtgccccgaatgggtttttaccaagccttttttctttcatgtatttacagnccggagcacaagatctcttcttcaaatacaatgtaatcgntttactttacaacacta

SEQ ID NO: 25269 - DNA, 498 bp, Homo sapiens
  misc_feature 13, 48: n = A,T,C or G
cacacaggagaanaaccttatcagtgccacaactgtgggaaatccttnttttccaagtcacagcttgatatacatcatcgaattcatacaggggagaaaccttatgaatgcagtgactgtggaaaaaccttcacccaaaagtcacacctgaatatacaccagaaaattcatactggagaaagacaccatgtatgcagtgaatgcgggaaagccttcaaccagaagtcaatactcagcatgcatcagagaattcacaccggagagaagccttacaaatgcagtgaatgtgggaaagccttcacttctaagtctcaattcaaagagcatcagcgaattcacacgggtgagaaaccctatgtgtgcactgaatgtgggaaggccttcaacggcaggcaaatttccataaacatcaaataactcacactagagagaggcttttgtctgttacaaatgtgggaaggcttttgtcagaaatcagagtggattacccatcaaaga

SEQ ID NO: 25270 - DNA, 498 bp, Homo sapiens
  misc_feature 19, 32, 46, 77, 79, 84, 134, 172, 342, 492: n = A,T,C or G
aactacagacatttctgangagtgctggtgangacgaacttcagancttttgagtatacttcagtatactagtgcancngaggnacacaaagaaattctgtcttaataaagaaagctacttctcaagggtattntgtggctcagtccaagctctcctgtcccattgtgcatngtctgtgacatgcaacttacaaaactagcagttgtaacaataaatcacagccacttgcatgaaaggatattcattattctcaaatggcttttggactatcaaaaacagtaaggcttttgtcagaaatcacctttagtcaaaaggtttaagaagcaaattatttagtagcnagaacttatctcaggaaaggaaaatatgcatggttggtgagaatctaataacattaaaatgcctggggcaagatgcagtcaaagttgaagagactttattctcaataggtgattactggatgatatgcatatgatgcaaaaaaggtttgnggcatt

SEQ ID NO: 25271 - DNA, 237 bp, Homo sapiens
  misc_feature 47: n = A,T,C or G
caagtcattccatctgttccatctaagcgattcatgacctgcattcnttctaaatgacaggaaccacaagcaactcagtcagcaggcttcagaatcggtcatcctaaaagatattgcaggtcaatggctaatacactaacaaagaaagagcttatgcaaataagtaaggaaaatactgtttcaatgttaaatcattaaagacaaattcagactactcacaaagaagatctataaatg

SEQ ID NO: 25272 - DNA, 493 bp, Homo sapiens
  misc_feature 2, 426: n = A,T,C or G
gnaacggcccctttctttgcttagcacctcgacttcgcgcagttttcatcgaagactgttcattacgcattggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggntttgtaaggtatacagcagtaatctcctatttggggcaggttttcaataaagttttgattatgggta

SEQ ID NO: 25273 - DNA, 259 bp, Homo sapiens
  misc_feature 19, 20, 32, 37, 40, 42, 45, 51: n = A,T,C or G
tgagacccacattcatagnnttaaagatacanaggangananganagatanacaagttttcagggcataacaacagtgattctgaagagaaggacaagtctaagaagagaaagcttcatgaagaactttctagcagtcaccataaccgggaaaaagccaaggaaaagcccaggttcttaaaacacgagagttctagggaggcagcaaatggagccattctgattctgacaaaaagtccagaacccataaacatagccta

SEQ ID NO: 25274 - DNA, 500 bp, Homo sapiens
  misc_feature 9, 10, 29, 64, 99, 110, 465: n = A,T,C or G
tgcatgacnngcttgacaaactgtgcttnttcttttaaaaatgtgctatccagttttttgtacncacatacacaaaaacatacacaatggccatatcantcagccttttncatcttttcaccccttttctgcatattgggatatctgcaacccatattaatatcctagatttttgtttatacacgtataatccagttactagttgtaacacgtggcacattgccagattacttagaataaagctgcacatttgaccttttcaccagcaatgtggaatgataacaatttcttcacatcttctccagcagtaggtattttaattaattcaatttttgccagctagattgggcatgaaatgatgccttattattattttaacttggcttcctcctctacgtttaaaaactattgtctgatcattatgataattaaggaacaaactaatgaaaatgtaagcatcattgntttcttaaaggaacactttggaaactcaatttcag

SEQ ID NO: 25275 - DNA, 500 bp, Homo sapiens
  misc_feature 2, 7, 47: n = A,T,C or G
gngtcgntgaggtctccgcgccgctccctgtacaaactggtggtttnccgacttggaaagaggctttccggcagagatgccttggagagaatgagaaacagccgggacaggctcctaaacaggtaccgccagctggaagcagtgggccagggaattctcagaacagctttctagttcaagaggtgatggaagaagagtggaatgctttgcagtcaagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctgctgagtgggaggcaaacccactcatctgtcctgtatgtacaaagcctgtgatcttgggctgtgatcctctagagccagcttggactcacatcattctatggggttgaagacaactcattcctctg

SEQ ID NO: 25276 - DNA, 237 bp, Homo sapiens
ccttgtgacacaaggaggcaaagttatttggggaaaatatgcccaggttaccaacaatcctgaaaatgatggatgtataaatgcagtcttactggtttgacagcaatttcatatataattattgaggactacacaccaattgaaggaaactgccattactgtgatgtttctgaatactaccaaacagccatacatgtctgcaatgaagagatttattaaattgtaaacattaaagtg

SEQ ID NO: 25277 - DNA, 370 bp, Homo sapiens
taggctgtgagactacctattgtagatattgcaccctatgacattggtgggcctgatcaagaatttggtgtggacgttgccctgtttgctttttataaaccaaactctatctgaaatcccaacaaaaaaaatttaactccatatgtgttcctcttgttctaatcttgcaaccagtgcaagtgaccgacaaaattccagttatttatttccaaaatgtttggaaacagtatgatttgacaaagaaaaatgatcttctctttttttgctggtccaccaaatcaattcaaatgctttttgtttatttttttaccaattccaatttcaaaatgtctcaatgggctataataaataaacttcaacactctttttg

SEQ ID NO: 25278 - DNA, 496 bp, Homo sapiens
  misc_feature 5, 58, 485, 496: n = A,T,C or G
aaaancctccctccctactgctgctacacaagaccctgagactgacctgcaggacgantccatgaagagcctgatccttcttgccatcctggccgccttagcggtaagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgctataatcgctacttcaggaagcgccgagggaccaaatgagactgagggaagaaaaaaaatctctttttttctggaggctgcacctgattttgtatccccctgtagcagcattactgaaatacataggcttatatacaatgctctttcctgnatatctcttgn

SEQ ID NO: 25279 - DNA, 100 bp, Homo sapiens
  misc_feature 2, 29, 39, 57, 99: n = A,T,C or G
cngcacacctcatatgaatgggacgcttnacttaatatngtgaagacgccaagactnatgcaaattggttcacacgactgagtgcaatcactatcaaant

SEQ ID NO: 25280 - DNA, 354 bp, Homo sapiens
  misc_feature 1, 19, 129, 140, 195: n = A,T,C or G
ntcccatttacctgtgcgntgctgctgtctgctgcgtgattcagcaagtttcatctcaagagctttcctgtaaaggccgctgctttgagtccttcgagagagggagggagtgtgacccgcgacgcccantgtaaagaagnatgacaagtgctgcccgattatgagaagttctgtgcagaagtgcataatcccacntcaccaccatcttcaaagaaagcccttcaccttcaggagcatctcaaaccatcaaatcaacaaccaaacgttcacccaaaccaccaaacaagaagaagctaagaaaggtatagaatcagaggaaataacagaagacattctggttctgaaaatcaagag

SEQ ID NO: 25281 - DNA, 130 bp, Homo sapiens
  misc_feature 101, 126: n = A,T,C or G
gtaaacacgtgaaatttcaggaattatttctgtcctaaatagtatttaatctgagttttggaaatttaaatgtcggaatcgaatttagtttatattaattntcctggattcactgcttgctccggncaca

SEQ ID NO: 25282 - DNA, 497 bp, Homo sapiens
  misc_feature 25, 31, 38, 88, 144, 150, 168, 187, 323, 366, 404, 416, 431: n = A,T,C or G
gcgacaaacctaccgagcctggcgntggcgnaaagggnacagtttttaccctaaagtgcaaaagtgaaacatacaaaataagactaanttttaagagtaactcagtaatttcaaaatacagatttgaatagcagcattagtggnttgagngtctagcaaaggaaaaantgatgaataaaatgaaggnctggtgtatatgttttaaaatactctcatatagcacactttaaattaagccttatattaggcccctctattttcagggatataattcttaactatcattatttacctgattttaatcatcagattcgaaattctgngccatggcgtatatgttcaaaattcaaaccatttttaaaatgngaaagatggacttcatgcaagttggcagggggtctggnactaaaaattgngggtggtttttctgnttacgtaaccctgcttagtattgaactctctaccaagagggtcttcctaagaggagtgctgcatta

SEQ ID NO: 25283 - DNA, 500 bp, Homo sapiens
  misc_feature 5, 60, 61, 493: n = A,T,C or G
taaantatccccacgaagcagctggcaacctcaagaaggccctgctcatccagggctccnntgacgtggagatccgggcagagggcaatagcaggttcacgtacactgccctgaaggatggctgcaccgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatccaccctctacaggtcggacttttctcccctctctttctaagagacctgaactgggcagactgcaaaataaaatctcggggtctatttatttattggcntcctgta

SEQ ID NO: 25284 - DNA, 500 bp, Homo sapiens
  misc_feature 7, 492: n = A,T,C or G
aagcatnctctgccaagaccaaaaggaaagaagaaaaagggccaaaagcttaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgccaaaagacgttttctttggaccaaagatctctttcgtgattccttgcaacaatcaatgagaatcttcatgtattctggagacaccattcctgatttcccacaaactgcctacatcagtataactgcatttctagtttctatatagtgcaatagagcatagatctataaattcttacttgtctaagacaagtaaatctgtgtnaacaagta

SEQ ID NO: 25285 - DNA, 435 bp, Homo sapiens
  misc_feature 56, 59, 161: n = A,T,C or G
aaaattgcccatggaatccgtctcaataggagtgaaagatgggatgcctattgctnttncccacacgcaaaggagtgtggtggcgcctttacagatccaaagcgaatttttaaatctccaggcttccaaatgagtacgaagataaccaaatctgctactgncacattagactcaagtatggcagcgtattcacctgagttttttagattttgccttgaagatgacccaggttgcttgctgattatgttgaaatatatgacagtacgatgatgtccatggctttgtgggaagatctgtggagatgagcttccagatgacatcatcagtacaggaaatgtcatgccttgaagtttctaagtgatgcttcaggtgacagctgggagggttccaaatcaaatatgttgcaatggatcctgtatccaaatccagtcaagg

SEQ ID NO: 25286 - DNA, 252 bp, Homo sapiens
ctatatcactgcccaacatcagaaaacctgacggctatgattactattccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagc

SEQ ID NO: 25287 - DNA, 420 bp, Homo sapiens
  misc_feature 10, 58: n = A,T,C or G
aacaaaaccnataagccatcgcgcctgcccttccttgatattgcacctttggacatcngtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccattaacatttg

SEQ ID NO: 25288 - DNA, 246 bp, Homo sapiens
  misc_feature 241, 245: n = A,T,C or G
attatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaatttttttaacattcctcatgaatgtaaatttgtactatttaactgactattcttgatgtaaaatcttgtcatgtgtatnaaant

SEQ ID NO: 25289 - DNA, 257 bp, Homo sapiens
  misc_feature 2, 7, 57: n = A,T,C or G
anggaancccgtaggcagaaatgagcagttcgctcctccctgataagagttgtcccntagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagtt

SEQ ID NO: 25290 - DNA, 223 bp, Homo sapiens
  misc_feature 3, 45, 46, 221: n = A,T,C or G
aanccttgttctatttttcaatcaccaaaaagtaattataaatanntattacaaacaagtggatgtttttaatgaccaattgagtaagaacatccctgtcttaactggcctaaatttcttctggtagtgtcagttcaactttcagaagtgccacttaaggaagtttgatttttgtttttgtaatgcactgtttttaatctctctctctttttttttttttngg

SEQ ID NO: 25291 - DNA, 367 bp, Homo sapiens
  misc_feature 6, 14, 53, 54, 351: n = A,T,C or G
gatccntgcacatntcatggtagctggctgggaccaacgtgaaggaggtcatnntatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgcatctacctggtcactattacagctgccagtgtggaccatcgagtcatcttgggcaatgaactgcaaaattctatgatgagtgaaccttcccagacttctctttcttattttgnaataaactctctagga

SEQ ID NO: 25292 - DNA, 125 bp, Homo sapiens
catggccaacaatattgtccaaattgcatttgtaccccataaataaataatttttaaaattctgtctatataaaactaacttcaaatacagcataggtaagataaaagtaaaaagagagaaccag

SEQ ID NO: 25293 - DNA, 265 bp, Homo sapiens
  misc_feature 16: n = A,T,C or G
aaaaacacccacttgngcttttgtgaattaggaatgtcagtatataataacagaatgttttcaacttttaactatagactgtttacctgtgcttttaaattgggagatggttgtctgtgtttggagaaagtcattttgacaatcttggggctatatgggttttaattattcttagtagaaccattgcaggtatttcccattgactttaattgcagttctctgtagaaaaattttctgagaacccaatgtaatgtgttcactgagc

SEQ ID NO: 25294 - DNA, 498 bp, Homo sapiens
  misc_feature 1, 6, 398, 435, 446, 468, 490: n = A,T,C or G
naaaangagaccctcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgnaaacacttaagtatgcagttgataagaggaatttggnataattatggngggtgattattttttatactgnatgtgccaaagcttactactgnggaaagac

SEQ ID NO: 25295 - DNA, 497 bp, Homo sapiens
  misc_feature 5, 7, 59, 415, 473: n = A,T,C or G
aaatngncccagccagcgcaggggcttctgctgagggggcaggccggagcttgaggatnccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaagagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaaggtgnaggtgattaaaataatttgaaggcgatctttttaaaaagagattaaccgaaggggttnaaagaccttgaatccatgaccagg

SEQ ID NO: 25296 - DNA, 406 bp, Homo sapiens
  misc_feature 1, 9, 61: n = A,T,C or G
naaaaaatncccaacaattctgtgaaaggtcacaggacccaattggagaaatcatatgatnagcatagttggtcttggtggtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatg

SEQ ID NO: 25297 - DNA, 500 bp, Homo sapiens
  misc_feature 4, 11, 44, 462: n = A,T,C or G
cagngcagggncttctgctgagggggcaggcaggagcttgaggnttccgcagataagtttttttctctttgaaagatagagattaatacaactacttaaaaaatatagtcaataggttactaagatattgcttagcggttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttaagtttaaaagttgtaggtgattaaaataatttgaaggcgatcttttaaaaagagattaaaccgaggtgattnaaagaccttgaaatccatgacgcaggggggaattgcgt

SEQ ID NO: 25298 - DNA, 416 bp, Homo sapiens
  misc_feature 48, 341, 407: n = A,T,C or G
caaaggggatgtgcctttttatttttgtttttaatgctttgatatttnaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcaagtgccttggcaggctgatttctaggtaggaaatgtggtagcctcacttttaatgaacaaatggcctttattaaaaactgagtgactctatatagctgacagttttttcacctggaagcatttggttctccttgatatgactggttncgggacagttatttgtgagagtgtgcccaaaggtacatgtttgccccttctagtggaaataaaggnatatttttc

SEQ ID NO: 25299 - DNA, 499 bp, Homo sapiens
  misc_feature 2, 42, 63, 123, 138, 177, 250, 307, 309, 439, 471, 496: n = A,T,C or G
gnccccttcaagcatgaagccatggaccctcgtggtgagtgntacagttcttttagatggtgngtctggagtttgttccttctgatgttctgatgttcagatgtgtccagagtttcttccttncagtgggttcatggnctcgctgacttcaggagtgaagcttcagaccttcgcagngagtgttacagcttatcaaggtagtgtggatccaaagagtgagcagcagcaagatttattgtgaagagggaangaacaaaacttccacaacgtggaagaggactccagcaggttgccactgctggcttgngngccagcttttattccattatttggccccacccacatcctgctgactgggccattttatagagcgctgattggtccattttacagagcgctgattggtccattttacagaagtgctggttggtgcgttacnatctttagctaagacatagaatgctgattggngcgcttttacagagggctgattggnggg

SEQ ID NO: 25300 - DNA, 338 bp, Homo sapiens
  misc_feature 26, 49, 51, 256: n = A,T,C or G
cttttagcttagggcctggtggctanggtcggttctctcctttccagtntnagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaatacccagagccctggaacaaactgggcccaatgatcaatacaagnctactcagtgaatgtggattacagcaaagctgaagaagggacgtccagatttctaaatgaaatgtttcactatacgctgctt

SEQ ID NO: 25301 - DNA, 244 bp, Homo sapiens
taacagaacccgatgcaaacaaatgttctctcaacttacatccaggataagctaaaatattactttaacacatgttgaaagtagagtgctctatttggctagatataattccaggctgtctaagttgagtaatttcctcagacattccaactttgatcaactgcagcaagaacttttagcatgtctgtaaagcagccagtgcatctgtaaatatgtcctgagatagggagaaaagagaatgccg

SEQ ID NO: 25302 - DNA, 133 bp, Homo sapiens
  misc_feature 20: n = A,T,C or G
taaccaaaggcaaagaagtngaaaactttgaaaaaatttagaagaatgtataactagaataaccaatacagagaagtgcttaaagtagctgatggagctgaaaaacaaggctcgagaactacgtgaagaatgc

SEQ ID NO: 25303 - DNA, 295 bp, Homo sapiens
  misc_feature 28, 29, 35, 54, 85, 122, 151, 167, 206: n = A,T,C or G
cctgagcaggagacgcgaaccaacatgnngctggngctcgcaaggtcacttttnaataggatggactttgaagacttggggttgngagtagattgggacaccacctgcctacaccagctgcnaagactgtgggtgagaacctccccagganagtcatcagaggctcncaggctgagctcaagtgccccgtgtgtcttttggaattngaggaggaggagactgccattgagatgccttgcatcaccttttcattccagctgcattctgccctggctaagcaagacaaattcctgtc

SEQ ID NO: 25304 - DNA, 467 bp, Homo sapiens
  misc_feature 5, 10, 58, 164, 214, 230, 275, 279, 297, 328, 369, 417, 423,432, 462: n = A,T,C or G
aaaangtccnaagtataaatctggggaagaggttttatttacattttagggtgggtangaaagccaccttgttacaaattttttaatttccaaaataatctatattaaatgagggtttctgatctgtactttgtgtttagctacctttttatatttaaaaaaanaaaaatgaaaattacgttcttacaagcttaaagcttgatttgatctttgnttaaatgccaaaatgnacttaaatgagttacttagaatgccataaaattgcaggttcatgnatgnatataatcatgcccatgnatatttaggtacggataatgccttctgaggngaggtttacccttaaatcatttgggtaaaacattggcttgntggttacccccctctggaggttttaaataaaaaccttaaaggataagnctacantaaacaaangatcacatctaaagccttatccttgggggnatcca

SEQ ID NO: 25305 - DNA, 497 bp, Homo sapiens
  misc_feature 2, 272, 400, 435, 469: n = A,T,C or G
anagagaaccccattaaatacttgaatctgcatgacagtttgacttgaatgcaacagcttgaaaattttgcaagttacataattgtatatacagtaggttttcttaagtctcttcggttcatcctttgtaatttgtgtgtgtatctgtagtattgcaggcttttggagactattcttacaggcagtatgtcaagtcatcaaagaaaatgctgcacctgccattgttgtatttgtgggtatttataggtgtatgtatgtaaatgcatcagtgngtagattgcatatcagtgtatggtacatgtcatcaaaattatttttgccttaatcagtgtgatatgaaaagcaagtccacctcataggactgattatataatgaaggtgttgagagatatatagtggnattgtttattaacttaactcaaataatatttgatnaaattttaataagacttatgctagaaaatcttgngctttgaatcaccagggcaaaatgactt

SEQ ID NO: 25306 - DNA, 129 bp, Homo sapiens
  misc_feature 5: n = A,T,C or G
ctggnacaactgtccttagactgatgagcaaaggaggagtcaactaatgaagaaatgaataataaattttgacactgaaaaacattttattaataaagaatattgacatgagtataccagtttatatat

SEQ ID NO: 25307 - DNA, 494 bp, Homo sapiens
  misc_feature 58, 60, 405, 425: n = A,T,C or G
aaaactaacccctataccttctgcataatgaattaactagaaataactttgcaaggantnccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggctaaaagcagcaccaattaaagaaagcgttcaaagctcaacacccactcctaaaaaatnccaaacatatactgactctnacacccaattggccaatctatcaccctatagaagaactaatgttagtataagtacatgaaaacattctc

SEQ ID NO: 25308 - DNA, 254 bp, Homo sapiens
  misc_feature 231, 238: n = A,T,C or G
gaggccaaggcgggaggattgcttgagctcaggagttcaaaaccagcttggacaccatagtgagacccccatctcttaaaaaaatatataaaaattaataggacaagcgcagtgtctcatgcctgtaatcctggcactttggaaggccgaggcaggaagattacttgagctcaggagttcaagaccagccagtacaacatagtcaaaccccatctctaaaaaaaaataatnaataatnaaaacataaaacttgc

SEQ ID NO: 25309 - DNA, 500 bp, Homo sapiens
  misc_feature 320, 365, 417, 428, 459, 468, 497: n = A,T,C or G
atattcctactcggtcatactggactggcttcgttctcttaatatactcagtaatgactcaagcctctggctattaacataccttagtcgccgttttttaattgccatgagccaaatacttcttggtatacaattgatccatttattttaatggccgccttttcattttcatcttttcttgctgctacccatctatgtatgtagtcattggggggaaaatgtagcccattttttatgggaagacttgtgtaaaagtgaacattttgaagggttttaactggtgaaactagcctggaataatgccccagagactgagtggnaatcgcccttttggaaggtgccattcttatgagccaaaaggttgncatttaaaaggtcattttgagggaatacatgtaatataattggaataaaggnatagtaccctnaaaagacatatactgatggtgggaatggggngaattggtnaaatgagtactttgataagttttcatgcncag

SEQ ID NO: 25310 - DNA, 500 bp, Homo sapiens
  misc_feature 10, 49, 449, 490: n = A,T,C or G
gctattgacncataaaagtgttatcttgaaaagctgctgaaagatgttncttgttctcatctcctcagttgctttgcccccacaaatgctggtgtactgctgtattcaatgtgtataactttaaatacagtttctgttgtctaaaaagcattgaatcatcttttattttgaaatggtattgattgcatgtttaaatgataatactttggaggtattggattaaataaactgtgtgtgtgtatatgtgtgttttctgcagtgaaaacacttattttacaacagtaatctttattttaggcaacattcaaacatacaagaaatgtgttgttacaattaaaatttttttaaaaagtagtggagcatcatcttcatcccatccctcttaagccctgacttgacaccctaagaaacttcttgaattattctgggctggccgacacctgtaattncagcactttggggaggccaaggcagggggatcacttgaggncaagaattcg

SEQ ID NO: 25311 - DNA, 282 bp, Homo sapiens
  misc_feature 58, 209, 272: n = A,T,C or G
gacaccccccaaagggaaccgcagggactacggaaccactcagaggatggggaccctngatgtcccctggcagggcacctgtaaaacccaattttgataaataattatatctaacacatttttaaggaaaaaaaaaagaaaggtttttcttaattgccaatgagcaattctctcaaggtttaaacctgaagactgtcttgcatgctttngtattattaactataattcttatcttcagagtatttcatctgcaattttcaagtttacttttntcacagacct

SEQ ID NO: 25312 - DNA, 260 bp, Homo sapiens
  misc_feature 47: n = A,T,C or G
catagctcgacatatttaggtttcattatatgcacataaacattggnttaacacaaatgatctgcatttctggtttaaactgatatttgtgcttattaatttttttgcatattaagagattgtcatgacttagtttttctattgatttaatttatgctgtcagaatttattgtaacactatatcaactgtagaagtaaacatttaaaaagtttaatgcagtaggattgcattgaatgattgttatagatcagaataaagg

SEQ ID NO: 25313 - DNA, 497 bp, Homo sapiens
  misc_feature 57, 58, 282: n = A,T,C or G
aatcaaaccactcaaccttttggaatttgatcctctactgtaatactcatatgctannttactgaattttccgagtgaaaaaaaattgacagggtaatatataggccatattatagtgaagatcataagtataaatgtcctcgtttaatctttccatattgaggacagcctctgcatataaaaatgttcattgggagaaaaattatttttaaaactaaatttttatagtagtcctccattactggcaattaaggagcaacccacaaaatgtcattatgtggntctttgattaggcataaaaagtattgcgaacagcttttctattcctttggaatatgaatctttttaatgtctaaaggtaacctgcaacattttctagtaggacaagtcaatgtaaattaaggtaattttgcctgtttatccttctggtgcattttgtcaaatgaaaacatttttaaaacatgattgaatttttacttctcagataattgggttga

SEQ ID NO: 25314 - DNA, 237 bp, Homo sapiens
  misc_feature 7, 12, 34: n = A,T,C or G
cccgagnctggngatagctggttgtccaagatanttatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatc

SEQ ID NO: 25315 - DNA, 500 bp, Homo sapiens
  misc_feature 2, 47, 318, 324: n = A,T,C or G
gncaaggaggacaacaggctatttttctgagttactaggaggatggnttgattgtacattgagaggaagaataggaaaggaaggggagattaggtgctggcttttttgttgtttgagatacttgttggacattcaagtaaatatgctttatacattctggacatgtgaatcgagtttagaggaagagtgtgggctacaaatacaaattactaagccatcagcttggtatataaagccaatacatctcattgtaatttctttctcaaattctgacttagtgtctaattcttctcattcctgtaaatttctttagggtgnttttgnggtttacctatcatttcattctctgccctagaacaataacgcaataaatgtttgtcaataaaggaaagaatggataaaagaatgatggaggaaggcttataaaatgtgtcaattagtgtcttaattaataggcaatagagtaaaccatttaagattctgacagaactttacttgat

SEQ ID NO: 25316 - DNA, 497 bp, Homo sapiens
  misc_feature 454: n = A,T,C or G
cttgaaaagttagagaagtccaaaaagacttttcttgataaggacgcacaaagattgagtccaataccagaagaagttccaaagagtactctggagtcagaaaagcctggctctcctgaggcagctgaaacttctccaccatctaatatcattgaccactgtgagaaactagcctcagaaaaagaagtggtagaatgccagagtacaagtactgttggtggcagtctgtgaaaaaagtagacctagaaaccctaaaagaggattctgagttcacaaaggtagaaatggataatctggacaatgcccagacctctggcatagaggagccttctgagacaaaggggtctatgcaaaaaagccaattcaaatataagttgggtcctgaagaaagaaaccactgcctcagaaaatacagagataacctctgaaaggcagaaagagggcatcaaaattnacaatcaggatatcaagtcggaaaaagaagcccgatctccccc

SEQ ID NO: 25317 - DNA, 500 bp, Homo sapiens
cttaaccagctcccatagttatataaggtcaaattcctgtaataaattccatgttctatacaattcctaatggtttgtattgttattattttttattaaatcttgatatacaatttgctgctactaagccatgtagtaggagctttgggactgagcttgagtgtaagttagaagggccttgaagagactgttaacaggagcctaatgtcacttcaggaagctattggtgaaggtttaaacaaggtgagagatattattggaagctggaagaaaggtgactcttgtgacatagtaagcagaaattttagcaatgctggaaatttattttccatgaaacagtggaaaataagtatagctcaactggatgatctcactaaagagatttctaggcaatgtcaaaggtgctatctggattcttctagcccctatagcaaaagacaaaaggagaaaggcaagcaagataaaaaattggtccgatataaaggagccacaactttttg

SEQ ID NO: 25318 - DNA, 497 bp, Homo sapiens
  misc_feature 22, 37, 404, 446: n = A,T,C or G
aaaaagacccaaggaaaagggncattgaaagatgacntttaggctaagcttagaatgattggtgggattttgagaaccagaaaggggaggggagagcattcagcaaagcagatggctaaaaatacggaagtaagaacaaacctggtagaggagggagctaagaagaaaccagcctgattggaggaaatggaatatggagggagtagtatcaaagaaggttaaatataggccaagtgcagtggctcatgcttgtaaacccagcattttgggaggccgagataggtggatcacttgaggtcaggagttcgagaccagcctgcgaatatggtgaaacctcatctccaacaaaactacaaaaaattagccaggcatggtggcacgtgcctataatcccagctactcangtggcttgaagcaggagaatcactttgacctgggaggtggangttgcagtgaaccgagagctgagatggcccacttctcttcagcctggtgac

SEQ ID NO: 25319 - DNA, 498 bp, Homo sapiens
  misc_feature 2, 8, 379, 437: n = A,T,C or G
anaaattncccctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagatttttttccatgactgcattttactgtacagattgctgcttctgctatatttgtgatataggaattaagaggatcacacgttggttcttcgtgcctgttttatgtgcacacattaggcattgagacttcaagcttttctttttttgncacgtatctttgggtctttgataaagaaaagaatcctgtcattgtaagcacttttacngggccgggtggggaggggtgctctgtggtcttcaattaccaagaattctccaaacaatttc

SEQ ID NO: 25320 - DNA, 500 bp, Homo sapiens
  misc_feature 4, 23, 31, 389, 419, 445, 465: n = A,T,C or G
cttntgctgagggggcaggcggncttgaggnttccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaggattaaaatgaaggtgacttaaacagcttaaagttagttaaaaggttgnaggtgattaaaataattggaaggcggatcnttttaaaaagaggatttaaccgaggngattaaaagaccttgaaatncatgacgcagggaggaattgcgcatttaaagccta

SEQ ID NO: 25321 - DNA, 485 bp, Homo sapiens
  misc_feature 2, 24, 322, 378: n = A,T,C or G
tncagtccgttgctttactttttncttcaccgacatagtcattatgccgaagagaaagtctccagagaatacagagggcaaagatggatccaaagtaactaaacaggagcccacaagacgatctgccagattgtcagcgaaacctgctccaccaaaacctgaacccaaaccaagaaaaacatctgctaagaaagacctggagcaaagattagcagaggtgctaaagggaagaaggaggaaaagcaggaagctggaaaggaaggcacagaaaactgaatctgtagataccgagggagaatgaattgtcatgaaaaattggggntgaatttatgtatctcttgggacaacttttaaaagctattttaccaagtattttgnaaatgctaattttttaggactctactaggtgggcatatgaaaatatataaggatggacattttatcgctcatagtcatgctttttggaaatttacatcatcctcagt

SEQ ID NO: 25322 - DNA, 482 bp, Homo sapiens
  misc_feature 5, 13, 422, 449, 480: n = A,T,C or G
tggangtgagganccatagataggcttgatattttacttttctttctttcctgcaggctctcaaagatattttttctccttaagtttgagcatatttcatgtaaataaaagggatcccaaagagcatcttgtgcgaacccttggctcaagacaacccaacctaaaattcatctagatcacctggacttttacgttgaaaggatttttcccccagaataggacatttgtttcccatctattctggcttacaatactgaagagtcccagtccatatttatgaaggaagcagccttaaagtgttaccatgaacactttataaacaggcattgtgggcctttgaaaagaaagctgctgatgtctgagttttatgggagcctagccagctgtttaagtgttcttcttaacacttaagtatattttgnaacagaagaaaaatgaaaattagtatntctgcgcttcataattatcatattaaagagntg

SEQ ID NO: 25323 - DNA, 280 bp, Homo sapiens
  misc_feature 11, 13, 236, 239, 251, 273: n = A,T,C or G
gaataaaaccnanatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcangtntccaaccaactnggttctgcttcaataaatcttnggaaaac

SEQ ID NO: 25324 - DNA, 271 bp, Homo sapiens
  misc_feature 47, 48: n = A,T,C or G
gacctcaagataacatttttcattaaagcatctgagatctaagaacnnaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaat

SEQ ID NO: 25325 - DNA, 500 bp, Homo sapiens
  misc_feature 4, 31, 49, 474: n = A,T,C or G
cggnatctgctttgcaatcccatctgataanattaaaaagttcctcacnttagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggccgcaggggtaatgaagatatcatgatcacagtgattcccgaagaaattgacccatagcagaggcacgagctggacttcatgtttcccttcaaagactctccgtggatgacggatgaagactctgggctgctggnataggacactcaagacttttgactgc

SEQ ID NO: 25326 - DNA, 396 bp, Homo sapiens
  misc_feature 4, 20, 58, 60: n = A,T,C or G
aaanttaacccattaatgcnaacagtacctaacaaacccacaggtcctaaactaccantnctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaaccgattaaagtcctacgtgatctgagttcagaccggagtaatccaggtcggtttctatctacttcaaattcctccctgtaccga

SEQ ID NO: 25327 - DNA, 250 bp, Homo sapiens
  misc_feature 27: n = A,T,C or G
cactttgggaggccaaggtgggtggancacctgaggtcaggaatttgagaccagcctggccaacacagtgaaaccatgtctctactaaaagtctaaaaattagctgggcgtggtggcatgcgcctgtaatcccagctactcaggaggctgaggcaggagaatcgcttgaacccggggaggcagaggttgcagtgagccgagatcgcgccactgtactccagcctgggtaacaagagcgagactccatctc

SEQ ID NO: 25328 - DNA, 250 bp, Homo sapiens
  misc_feature 5, 16, 224: n = A,T,C or G
gttgncagtatctatngaaactggactaggtactgtgggttaatacatggtgactacttttcagaaaaagctaggtctagttgaggggagaaaatatacataaataaaaattaaatatttgagttctcaatttttcaaaaatggataccactagaaatcgtactttaaagaaaataatcttgaaaaaatgtgtattttcctgctagaacatgatgagtgattgnacatgagagtaaatgcagcaagaaat

SEQ ID NO: 25329 - DNA, 167 bp, Homo sapiens
tgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctg

SEQ ID NO: 25330 - DNA, 468 bp, Homo sapiens
  misc_feature 5, 162: n = A,T,C or G
tattntcccgaggaagacgcggtcgtaagggctgaggatttttggtccgcacgcttttgctcctgactcaccgctgttcggctctcgccgaggaacaagtcggtcaggaagcccgcgcgcaacagccatggcttttaaggataccggaaaaacacccgtggngccggaggtggcaattcaccgaattcgaatcaccctaacaagccgcaacggtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaag

SEQ ID NO: 25331 - DNA, 429 bp, Homo sapiens
  misc_feature 4, 24, 54, 55, 57, 60, 85, 100, 110, 128: n = A,T,C or G
atcngggtatatattcaagatttntggcagcattcagcatgtatatttataagnngngancctgtacagaagtgccctggaaganggcctgctctaaatnatccagtgtntggagaaacgacacaggngaggagacgcgctttgaacgtgctataggaccttctcaaacacacaccatcagaattcaatattcacctgccagactgcttatcaagacaaaggtgtccttcataatgaagttaaagtgagtatactgtggaagaggacttccaaatgtggtacctcaagctatatcactgcccaacatcaagaaaacctgacggctatgattactatgccttttctaaagatcaatactataacattgatgtcctaggagaacaagcaagagcaattactactcgttctgggcagaccttatccaaagtc

SEQ ID NO: 25332 - DNA, 289 bp, Homo sapiens
  misc_feature 19, 26, 37, 53, 57, 76: n = A,T,C or G
cttttttattttatgtagngtgtgangcttttcaagngacccggtccattttntggnagatacagccatccacctncagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgccaac

SEQ ID NO: 25333 - DNA, 101 bp, Homo sapiens
tagcaataaacgaaagtttaactaagctatactaacctcagggatgggcaatttcgtgccagccacggcggtgacacgattaacccaagtcgatagaagcg

SEQ ID NO: 25334 - DNA, 166 bp, Homo sapiens
taaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagc

SEQ ID NO: 25335 - DNA, 409 bp, Homo sapiens
aagtgccgaatgttattagaatcaacattgcatccttcttgcttatacgttaagttacataaaaggaaaacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtaggattaagtctcagaatggacactacaaatgccagctctcaccagatggcctacgtgtttgaactgccatagtcagtgtgtgtgtgtgcatttatgtatgctctgtggctacatatacacacacgtatttccttgagataaacaagataaacactaggtgcttttgaatttttttcacttccctttatagttttgggaaaggagtg

SEQ ID NO: 25336 - DNA, 446 bp, Homo sapiens
  misc_feature 2, 44, 390, 426: n = A,T,C or G
gngtggatcaatagtagttgtttttccttttttgtttttttctnttatgactgagtgatactctgttgtatggagtatgccacagttagtttatcccttcactagtagaagatcctgtacactgtttctaatttgggggattataaataaagctgctgtaaacatttatgtcatttatgtacagattttcatgtggccgtacattttcagttcattttggtaaatacttagaagtgggattgctaggacatgtagtaggtgtatctttaacttttttagaaacctgcagacttttctgaagtggttgaccgttggaaatggctatgccattgctctgcaccagacttgggtgttgcagggttttacttatttgcacaattctaatagggngctagggggaccacactgtggttttaatttgaactnctctaatgactggatgatgt

SEQ ID NO: 25337 - DNA, 335 bp, Homo sapiens
  misc_feature 4, 11, 54, 334: n = A,T,C or G
ccanacttaanagtagaattcaagatccagcaaaactatccttcaaaactattngaaaggatgagcatggtggctcacacctgtaatcccagtactttaggaggctgaggcaggaggattgcctgagcccgggaatttgagaccagcctgggcaacatggcaaaaagccatctctacaaaaaatacaacaaactgctgggtgtggtggcatgtgcctgtggtcccagctactcaggaggctgaggcgggaggatcacttgagtctggcaggttgaggccttgattgtgtcactgcactcctacttgggtgacacaagtgagacaccctcaaaant

SEQ ID NO: 25338 - DNA, 468 bp, Homo sapiens
  misc_feature 1, 2, 59, 61: n = A,T,C or G
nnaaagtcccgctgacctctctgaggctgccaacccggaacaatgacgccctgcgccantnaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgctgcaggatgagattcagaatatgaaggaggaaatggctcgtcgccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttcttgattaagacggttg

SEQ ID NO: 25339 - DNA, 452 bp, Homo sapiens
  misc_feature 3, 16, 46: n = A,T,C or G
ganggaagctgccgcngtagttggagtctaaggactcgtgacattnttcgggtgcccttcgagagaaaaggggaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgtcagaaaaattacaaccactgctggatagtctggagcagcttagtgtgtctggggcagaccgaccaccttctatctttgagtgccagctacatctttgggatcagtggtttcgaggctggctgagcaggagcgcaatgaatttgtcagacaagctggagttcaagtgagccagacttc

SEQ ID NO: 25340 - DNA, 466 bp, Homo sapiens
  misc_feature 55, 57: n = A,T,C or G
aaacatccggagccaaagacaatgaacttagacagaagaagaaggagcttcttgntngaaaaaccaagaaaagacaactggaacaaaaaatcagttccaaactaggaagtttaaagctgatggaacaggatacttgcaatcttgaagaggaagagcgaaaagcaagtaccaaaatcaaagaaataaatgttcaaaaagcgaaacttgttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcaagactcttc

SEQ ID NO: 25341 - DNA, 150 bp, Homo sapiens
ataaatccaagaagcgttcaactctttgcctgtcctggcctttactggatcccaaaagcatttaaggtacatgttccaaaaactttgaaaagctaaatgttccccatgatcgctcattcttcttttatgattcatacgttattccttata

SEQ ID NO: 25342 - DNA, 327 bp, Homo sapiens
  misc_feature 58, 89, 286: n = A,T,C or G
aatcgtcccctccggttcctgggctcctaattcttggtccagcttcttccaggtcttngcgtctgttgttcccagcgctctgcgaagcntgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaggaagttagaaaacgaggnaaagacagaaaacaagggcaaaacaggagatgaggaaatgt

SEQ ID NO: 25343 - DNA, 438 bp, Homo sapiens
  misc_feature 3, 10, 27, 28, 41, 385, 388, 389: n = A,T,C or G
ganggggcangcggagcttgaggattnngcagataagtttntttctctttgaaagatagagattaatacaactacttaaaaaatatagtcaataggttactaagatattgcttagcgttaagtttttaaccgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagccgccngcnnccaaaataatttgaaggcgatcttttaaaaaagagattaaaccgaaggg

SEQ ID NO: 25344 - DNA, 451 bp, Homo sapiens
  misc_feature 7, 46, 49, 392: n = A,T,C or G
tgtaggngactgagtgaggaactaaatgagttaatactcagagtanttncttgcaccatagaatacgtacataatccatacaagatggatgtaatgtatgtattatgaaaagtagcacaaatgggcacaaggtggctacagtgtgtccaggctttgtttcagtgccttttttttagaggcaaagcagctttcccaggggccttctgtctactttccctgtcatctcattgaccaacgttgagtcacaagtccttttcgaaattagttatgtacaaagggaatggctgtctctggtggcttggctaattatttggggaggaatggttggtgaggaattaagcacttcagccactattattacttgtaacaataatatctataatatataatgnaatatcattatatttcaaatgtaatactaagttatacaaaattattaaaaagcaacaat

SEQ ID NO: 25345 - DNA, 423 bp, Homo sapiens
  misc_feature 3: n = A,T,C or G
canggggtagtgttttttgtccctgtcttgccgtagatattgacaaactgaagctttcctgcaccactggacttaaggaagagtgtactcgtaggcggacagctttagtggccggccgccgctctcatcccccgtaaggagcagagtcctttgtactgaccaagatgagcaacatctacatccaggagcctcccacgaatgggaaggttttattgaaaactacagctggagatattgacatagagttgtggccaaagaagctcctaaagcttgcagaaattttatccaactttgtttggaagcttattatgacaataccatttttcataagagttgtgcctggtttcatagtccaaggcggagatcctactggcacaagggagtggtggagagctatctatggagcgccattcaaagatgaat

SEQ ID NO: 25346 - DNA, 464 bp, Homo sapiens
  misc_feature 59: n = A,T,C or G
taaaaaaacctttatcatgaccaagcgggatttattccagttacgcaaggatggttctncatatgcaaatcaatcaatgatacatcatatgaacacaaggacaaaaacgatatgattatttcaatttttgctgaaaaagcatttcataaaattcaacatcctttcatgattaaaaacccacagaaactgtgtatacaaggaatataccttgacacaataaaagccatatatgacagacccacagctaatatagtgaaggggaaacacctgaaggttttctccctacaatctgaaatgagacaaacatgctcactttcaccactgttattcaacatagtactggaagtcatagctagagaaatcagacaagagaaagatataaagggtatccaagttggatgtcaaattatccttgtttgcagatgatcgatcttatatttggaaaaatctaaagactctccaat

SEQ ID NO: 25347 - DNA, 265 bp, Homo sapiens
  misc_feature 8, 16, 100, 102, 109, 201, 231, 240, 256: n = A,T,C or G
tggctatnccatatgncttctgcataaggaattaactagaaataactttgcaaggagagccaaagctaagacccccgaaaccagacgagctacctaagananagctaanagagcacgcccgtctatgtagcaaaatagtgggaagatttataggtagaggcgacaaacctaccgagcctggtgatagctggttgccaaganagaatcttagttcaactttaaatttgcccncagaacccnctaaatccccttgtanatgtaactg

SEQ ID NO: 25348 - DNA, 191 bp, Homo sapiens
  misc_feature 28, 61: n = A,T,C or G
tgctgagggggcaggcggagcttgaggnttcgcagataagtttttttctctttgaaagatngagattaatacaactacttaaaaaatatagtcaatagggttactaagatattgcttagcgttaaagtttttaacgtaattttaatagcctaaagattttaagagaaaatatgaagacttagaagagtagc

SEQ ID NO: 25349 - DNA, 230 bp, Homo sapiens
  misc_feature 48, 224: n = A,T,C or G
ctgctatgaaaaaacgacatttggaaattctggggtatcgtgtaattnatgatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaattnaaaaat

SEQ ID NO: 25350 - DNA, 434 bp, Homo sapiens
  misc_feature 8, 9, 37: n = A,T,C or G
accgattnncagagaagaaacaggggcttgaaatttnctatttgccacatcttctagctacgtgaccttggacaatcatgattttggctgaggcttcagattctaaacttttcccgtactttatggaaaaaaaggaacttgttttagatttggatatacaaaacatgagttgcctttgggcatttaggtagaagcaaaaggagatgattatttagaacattaaatttggaaaacgctagaactcaaacttggctgacactattaactatgggtcttagagatattattttcccaacactcaattttctcattttgaaaaaagaccaataactaagcagttactttgcttactgctgtgctgtctcgatgcattatctcatttaattctcaagaagaacttcattaaataaattctaacaagaagaatgcccggt

SEQ ID NO: 25351 - DNA, 467 bp, Homo sapiens
  misc_feature 8, 17, 42, 60, 65, 130, 376: n = A,T,C or G
taataggnccggttggntttgatgggtcgagcttgtttgtgnccctgtgggtggacgttnttggngattggcaggatcctggtatccgctaacaggtcaaaatgcagatcttcgtgaaaacccttaccgncaagaccatcacccttgaggtggagcccagtgacaccatcgaaaatgtgaaggccaagatccaggataaggaaggcattccccccgaccagcagaggctcatctttgcaggcaagcaagctggaagatggcgtactctttctgactacaacatccagaaggagtcggaccctgcacctggtcctgcgtctgagaggtggtatgcagatcttcgtgaagaccctgaccggcaagaccatcaccctgnaagtggagcccagtgacaccatcgaaaatgtgaaggccaagatccaagataaagaaggcatcccccccgaccagcagaggctcatctttgc

SEQ ID NO: 25352 - DNA, 428 bp, Homo sapiens
  misc_feature 1, 61: n = A,T,C or G
naaatagacccgaaacccaagtccaaacccaggacttcctgcttaaagccccttctttttnaaaaactacattacctattgattattttgctttacatgtgcttacatgttgatcttcctcagtggactgccttcattccttaataggaaataaattgtcttttttggaggtgttacatttttgcatataacattaataagattaaaattttcatttgttgttgacattctttgcttgactctacactccacgggataggatccttgggcatagaaaccacgaatgctttgctcatcactgaatccagcatctgtcagtgtctgccatataggaattgctcaatatacatttttgagtaaataactgaactaacaaatgagtgaacaaaataacaaatgaataaaaaacctcagatctagcccctaac

SEQ ID NO: 25353 - DNA, 311 bp, Homo sapiens
  misc_feature 9, 49, 99, 102: n = A,T,C or G
atgacatgngctgtcccgattatgagagtttctgtgcagaagtgcattntcccacatcaccaccatcttcaaagaaagcacctccaccttcaggagcanctnaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacagaag

SEQ ID NO: 25354 - DNA, 278 bp, Homo sapiens
  misc_feature 63: n = A,T,C or G
gccaacgctatcaggccagcgttttaaaactagaaaaagagatgaaaaagagaggtttgaccntactcagtttcaagactgtattattcaaggcttaactgaaaccggtctgatttggaagcagtagctaagtttcttgatgcttctggagcaaaacttgattaccgtcgatatgcagaaacactctttgacattctggtggctggtggaatgctgccccaggtggtacactggcagatgacatgatgcgtacagatgtctgcgtgtttgcagcccaa

SEQ ID NO: 25355 - DNA, 453 bp, Homo sapiens
  misc_feature 30, 429: n = A,T,C or G
gcagaaaaggcctttgacaaaattcacgtngcccttcatgctaaaaactttcaataaactaggtattgatgggacgtatctcaaaataataagagctatttatgacaaacccacagccaatatcatactgaatgggcaaaaactgggagcattccctttgaaaactggcacaagacagggatgccctctctcaccactcctattcaacatagtgttggaagttctggccagggcaatgaggcaggagaagcaaataaagagtattcaattaggaaaagaggaagtcaaattgtctgtgtttgcggatgacatgattgtgtatctagaaaaccccattgtctcagcccaaaatctccttaagctgataagcaacttcagcaaagtctcaggatacaaaataaatgtgcaaaaatcacaagcattcctatncccaatgacagacaaacagaggcc

SEQ ID NO: 25356 - DNA, 129 bp, Homo sapiens
accatggtgaccacgggtgacggggaatcagggttcgattccggagagggagcctgagaaacggctaccacatccaaggaaggcagcaggcgcgcaattacccactcccgacccggggaggtagtgacg

SEQ ID NO: 25357 - DNA, 252 bp, Homo sapiens
aaacaatcctgcacattacaggcttatttataaagcttgttttatctaaactaagattttgtttatataattgaattttttgtgatttctgtagacattctatctagatgtttgaaaaataatctttggctttgcacaaacaaaatgatggctaaagttttcttgtggtgtcacatagtcacagtcttatacatgctttttttctgatttgtactaaatttttaagaaaaatatatttcccactaaattccg

SEQ ID NO: 25358 - DNA, 445 bp, Homo sapiens
  misc_feature 2, 3, 43, 265, 279, 432: n = A,T,C or G
gnnaagctggacaagccggataactggggtcatggccatgggnttggagaagactgtgctgggttgatttatgctgggcagtggaacgatttccaatgtgaagacgtcaataacttcatttgcgaaaaagacagggagacagtactgtcatctgcattataacggactgtgatgggatcacatgagcaaattttcagctctcaaaggcaaaggacactcctttctaattgcatcaccttctcatcagattgaaaaaaaaaaggcnctgaaaaccatttnctgaaaaaaaatggacggctggggttttttaccatccgcattcccaaagacttgggaactaaaatgttccccagggggatatgctgatttcattgggcacatggactgaatcacatagatctcctccgcagaaccgggcgattatacaaattntgttttccaaagt

SEQ ID NO: 25359 - DNA, 462 bp, Homo sapiens
  misc_feature 5, 23, 59: n = A,T,C or G
aaatnggccccggcactgcgcanaccagacttcgctcgtactcgtgcgcctcgcttttnttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgcttcttattttacttcttttagctgtttaactttgtaagatgcaaagaggttggatcaagtttaaatgactgtgctgccctttcacatcaaagaactactgacaacgaaggccgcgcctgctttcccatctgctatctatctggctggcagggaaggaaagaacttgcacgttggtgaaggaagaaagtggggtggaagaagtggggt

SEQ ID NO: 25360 - DNA, 210 bp, Homo sapiens
  misc_feature 15, 23, 28, 49: n = A,T,C or G
ataaagctgatgtcnaggacctntagangggtttaattcccaatctganttgagccctgactgcctttgttttggaaatcagcactaggttttaaatgacaaaattgtaggaaaattacatctaaattctggtaaactcttgctttaagatcttttttaaaaaaatgactaaattgattttttctttgcattgttttggttaagctctgt

SEQ ID NO: 25361 - DNA, 405 bp, Homo sapiens
  misc_feature 12, 28, 400: n = A,T,C or G
aagagagaaacngaggaccaagaagcanaggaaaaaacagaaagcaaataataaaatgtcaaacttaaaggctaacatcaataattactttaagtgtaaatagcctaaataagccaatcaaaagaaaaaatgcattaaaaaaaaacccaactatatgctgcttacaagaaactcacttcaaaatcaataagaggtatgttgaaagtaaaaggatggaaaagaatatatcatgcaaacagtaatttaaaaaataaaggcaggggtagctatattaatatctgatgaaggtagggagtaaagaaatttactagggacagagtaagacattatgtactgataagatattcaactcaccaggaagacctaatgatcctaaatgttcatgccccagacaacagancctca

SEQ ID NO: 25362 - DNA, 447 bp, Homo sapiens
  misc_feature 3, 7, 57, 377, 404, 440, 442: n = A,T,C or G
tanaatnccttccatgaaaactacaatgcaggcacttaccaaaatgacatcgctttnattgaaatgaaaaaagacggaaacaaaaaagattgtgagctgcctcgttccatccctgcctgtgtcccctggtctccttacctattccaacctaatgatacatgcatcgtttctggctggggcgagaaaaagataacgaaagagtcttttcacttcagtggggtgaagttaaactaataagcaactgctctaagttttacggaaatcgttctatgaaaaagaaatggaatgtgcagggacatatgatggttccatcgatcctgtaaaggggactctggaggccccttaagctgtatggatccaccaatgggcctatgctngggggttgggagtgggggggaaactgnggaaaccaaagtccaggtgttacaccaagtggccantntttgc

SEQ ID NO: 25363 - DNA, 126 bp, Homo sapiens
ctcagagctgttgcacagacagagattgtacttggtaagataccaaacaagacagatatggatctaaatttctaatgtgttctatgggtttcaattctgaaaaaagaaaatgaataaagattttaa

SEQ ID NO: 25364 - DNA, 232 bp, Homo sapiens
  misc_feature 16: n = A,T,C or G
aactataaacttatancttcagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttatt

SEQ ID NO: 25365 - DNA, 461 bp, Homo sapiens
  misc_feature 1, 3, 57, 429: n = A,T,C or G
nanttaacccattaatgcaaacagtacctaacaaacccacaggtcctaaactaccantcctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggtcgtttgttcaacgattaaagtcctacgtgatctgagtcagaccggagtaatccaggcggggttctatctacttcaaattcctcctgtacgaaaggacaagagaaataagggctacttacaaagcgccttnccccgtaaatgatatcatctcaacttagtatt

SEQ ID NO: 25366 - DNA, 389 bp, Homo sapiens
  misc_feature 57: n = A,T,C or G
aaaaagcccctgtgggcgacataaatacagaacggcccgggatgttggacttcacgntcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttggtacttt

SEQ ID NO: 25367 - DNA, 419 bp, Homo sapiens
  misc_feature 14, 35, 60, 62, 296: n = A,T,C or G
taaacagacccgcnaaggaagtttatgaatgtagnacctcgcaaagtgataagttatttntnagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggntttaaattatctttgtattatgtgcacatggttattttttaaatgaggattcactgacttgtttttatattgaaaaaagttccacgtattgtagaaaacgtaaataaactaatatagactatt

SEQ ID NO: 25368 - DNA, 462 bp, Homo sapiens
  misc_feature 10: n = A,T,C or G
aaaaaatccntttagttcatggtacaaaattcccaccccaagtgctttctgttttatttagcctcatacctctaaatgactgaccagtaaataaactattaagctgagaatattgagtgtcaagcagacattatctacagatttgctgagcactgaatgtttgaaaccagttgggccttgtgaaatatttctgcaatttagagcagctattcagtatccttgagttacaatataggaggctgttttattttattttgccttagttggtagcatgcatatcctactgaagaaggaggcaaaatgtatcaattattgctaagcataatagtagtttacttttactaaactaagtattaagtgatgtatttatatagagtactttaggaattcattaaaggttatattatcacattttatcatgaattctcaaagggtaggttttattatcccagtttataggat

SEQ ID NO: 25369 - DNA, 464 bp, Homo sapiens
  misc_feature 27, 55: n = A,T,C or G
aattgccccagccagcgctggggcttntgctgagggggcaggcggagcttgaggnttccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagctcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaagggcgatcttttaaaaagagattaaaccggt

SEQ ID NO: 25370 - DNA, 459 bp, Homo sapiens
  misc_feature 434, 446: n = A,T,C or G
ataatctcccataattttccacttaataactgtaaagtttttttctgttaatttaggcttatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggcagccagagctttctatgtactgttaaaattgaggcacatattttcttttgtatcctgcaaatactcctgcaggccaggaagtataatagcaaaaagttgacaaagatgaactaatgtattacattaccattgccactgattttttttaaatggtaaatgaccttgtatataaatattgccatatcatggnacctataatggngatatatttggtt

SEQ ID NO: 25371 - DNA, 422 bp, Homo sapiens
  misc_feature 5, 7, 406: n = A,T,C or G
aattntncctatccagactaataaagctatcagttgagggatttgcagttgataaattggctggagaggttagggctttcttcgagagtcacccagctccttcagctgagcgtaccatccagcagtgttgtgaaaatattctgctgaatgctgcctggctaaagcgagatgctgagagcatccaccagtacctccttcagcggaaggctcaccacccacagtgtgaatcctgaggtgccgcattggcggttctgctgcttcgctgcagggataaggtggagctaccgaacagctgattcatatgccaagaatttggagtcttctttcaaaccagtgggggttggacaatgaatgtaggtaactgggtcctgctcacactccagaattaaattctattgaaaaaggnaaatcagcaattcaac

SEQ ID NO: 25372 - DNA, 462 bp, Homo sapiens
  misc_feature 1, 7, 35, 56, 59, 377, 444, 455: n = A,T,C or G
naattgncccggccagcgcaggggcttctgctganggggcaggcggagcttgaggnttncgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggttctaaaacatgacggaggttgagatgaagcttcttcatggagtaaaaaatgtatttaaaagaaaattgagagaaaggactgcagaccccgaattaataccaatagaagggcaatgcttttagattaaaatgaaggngacttaaacagcttaaaggttaagttaaaagtgtaggggattaaataatttggagggcgatcttttnaaaagagattnaaccgga

SEQ ID NO: 25373 - DNA, 339 bp, Homo sapiens
  misc_feature 5, 24, 25, 52, 57, 58, 331, 339: n = A,T,C or G
taatngacccagccagggcagggnnttctgctgagggggcaggctggagctngaggnntccgcagataagtttttttctctttgaaagatagagattaatacaactacttaaaaaatatagtcaataggttactaagatattgcttagcgttaagtttttaacgtaattttaatagcttaagattttaagagaaaatatgaagacagaagtacgggaaggcgaagaaaagaatagagaagatagggaaattaggaagataaaaacatacttttaggaagaaaaaagataaatttaaacctgaaaagtaggaagcaggaagaaaaaagacangctagggn

SEQ ID NO: 25374 - DNA, 461 bp, Homo sapiens
  misc_feature 10, 57, 59, 427, 457: n = A,T,C or G
aaagggcccnattgagtttaccaacttatttacatgacatttctctatattggtgantnatgcaatgccattttgttacataaagttgtttgatgttttttaatatgccttcatataaatattttattcaatatgttgtatttgtgaatttaacaaatgatattaaacacaaactacaatgcagacagacaaactctttgtatgcaaattagcaatacataccaacagttcttgatacacaggtacctactacatgcagctcatcattgctgcctcttcccatgctacaggtgagaccagcacaaagtaaatgacctaactcaattacaaataacaaggacccctctgcaatatgtctaaacatatattagaaggaaagtatttgacatccttcatagggataaatgcccttatagaaccccatatnttaaacacaacagggatccacatttacatnaatc

SEQ ID NO: 25375 - DNA, 457 bp, Homo sapiens
  misc_feature 7, 16, 56, 439, 447, 450: n = A,T,C or G
aaaattnccacctggngactttgtggtgcactcacctctgatagtgacttgaattntgtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgcttgatttgattgcaggtttttcctaattataacaaattttcctcattggcctgtttttaatcctgtgcctagaaggagtcaaaatgcacactttacaaaattgatatttaacacttacccactcccctttncccatctnttntaccgtc

SEQ ID NO: 25376 - DNA, 134 bp, Homo sapiens
aagtttgaagaagtaggctgggcacaagtggctcatgcctgtaatcttagcactttgggaggccgaggtgggcagatcacgaggtcaggagttcaagaccagcctggccaacatggtgaaacaccatttttact

SEQ ID NO: 25377 - DNA, 462 bp, Homo sapiens
  misc_feature 36, 58: n = A,T,C or G
aaaagaacccaagggggaattggtggtgttagacangcaacttttattgaagtgacanttgtatagcagcagcagaggtactgttctttgtggagcagggctaacctataggcagtgtgcctaaagcagtagctcaggaacagttctgcagtcatatttatacccacttttaattacatgcaaatgaagtggtgtattcagaaatttctagaaagggggtggtaacttctgggtattaccatggcaatggtaaactgtcatggtgctggtgggtgtatcttatggagtggtgctttcagcacctcttccctgtttcagccagtctttagtctggccagagttgagtcctgccccttacctcagagagacatagtacctgtaaattccatgggaaatttagcttcccagagaaattcacagaaattgaaattctactacacagtaaaaatggtagcctcttgt

SEQ ID NO: 25378 - DNA, 152 bp, Homo sapiens
ctgaagtacaagggaagaaatgtaaatctataaattgggttaaatgatttctaggaaagtgtataataataataacaattatttttttgagacagagtctctgtcacccaggctggagtgaaactgtgtctcaaaataaataaataaataat

SEQ ID NO: 25379 - DNA, 242 bp, Homo sapiens
taagtggccctataaaattctaactttacatgtattttgttattagaaattttcttttattgaatgagaaaaattagtctatcattttaagagccaatatggcaaacactttcaaatactgtatattaggaaactgttttggtattcttgatggaaaaaaatgcagcggaaatgtcattatgaacagatgttaaataggaaattgttacttgttaacttcttacagcagtagtaccttcttt

SEQ ID NO: 25380 - DNA, 152 bp, Homo sapiens
tcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagat

SEQ ID NO: 25381 - DNA, 461 bp, Homo sapiens
  misc_feature 10, 57, 385, 461: n = A,T,C or G
aaaggagccnacatggcagcgcgttggcggttttggtgtgtctctgtgaccatggtntttggcgctgctcatcgtttgcgacgttccctcagcctctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattaagagtttgcacttattccatttgacctaagagaaaaataggctcagttagaaaaggactccctggccaggcgcagtgacttacgcctgtnatctcagcactttgggaggccaaggcaggcagatcacgaggtcaggagttcgagaccatcctggccaacatggtgn

SEQ ID NO: 25382 - DNA, 460 bp, Homo sapiens
  misc_feature 6, 9, 35, 57, 86, 397, 440: n = A,T,C or G
gaaaanccnataaggttgaactctgtataagtacntacagtagttatcattcttgtnctatagctatctgaagtccaactggaatnaccagtcaaaactgacaccaaaaccagtaggtgagggaaataacacaaaaaccagtaggtgagggaaacctaagaagctgaactgaattctcgaattatatcttatgttagtctcataaagctttattttataaattattcttataaacaaactataattcaaattgaatcaagtcttaagttctcagttgatcactgcaaactccgctccacagctcaagcagtctttctacctcagcctcccaagtagctgagacgacaggtgcctgcctgtcactatgtctggctttttatttttatttttatttatnttttggatttttagtaagagatgggggttcaccctgttgccangctggtctcaaactccttag

SEQ ID NO: 25383 - DNA, 458 bp, Homo sapiens
  misc_feature 56, 159: n = A,T,C or G
taaaagccctggtgctttgtaaatttcactccgtgtttctgtctcagaaagggcanttttatacctgtggtcatggtcctggagggcgattaggacatggagatgaacagacatgcttggtccctcggcttgtggaaggactgaatggtcataattgtncccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaagggacaatcattggcgttgcagcaggcaggtttcatacagtcctatggactaagagaagctgtttacactatgggactaaatggtgacaactgggttggttgctagatcccaatggagaaaaatgtgtactgctcctcgcagg

SEQ ID NO: 25384 - DNA, 463 bp, Homo sapiens
  misc_feature 1, 7: n = A,T,C or G
naatggntcccttttttattttttgtaggagatggggtctttctatgttgcccaggctgttctcaaactcctggcctcaagcagtcctcccaccttggcctccaaaagctctgggattacaggcatgagctaccatgcctgacctattctcacttaggagcatagatgataaattctgaaaagtttagcagtatcagaaattttcagatatggagaaagaggagttctcaaactgctagtttgagtataaattggtataaccacttttgagagcagtttaccaatatctagtaaaattaaagatgcttagactttaaaacctagcaattctaaatatatagtctaaagacactctcatgtatccacaagaattcatgacaaatacacaacattgcaaaattataagaataaaggaaaaataaaaccttagtattcatcagcagaagggtggatatatgctcta

SEQ ID NO: 25385 - DNA, 324 bp, Homo sapiens
  misc_feature 1, 4, 59: n = A,T,C or G
nganaaaccccgccccaatttcacttatattttgctaagcagatacacatttgccatgncagcttaaagtgtcggtgcttttgaatggagactattttatctcgatgtatctgtaactggagagtcctcatgctcaggactggtaactcagattttgttttgaaggaactaatttttaaaaaaatctggtaactcagattttgtttgaaaggaactaatttaaaaaaactttaatatatgaattttctggttaatttggatgaccaccatttttttgagtactgttaactgactttaggacctgcatttctaatccagatggtc

SEQ ID NO: 25386 - DNA, 290 bp, Homo sapiens
  misc_feature 1: n = A,T,C or G
naaagaaaccgtgataatacccaatgagaaaagtcttcaattacaaaaagatgaggcattaacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatag

SEQ ID NO: 25387 - DNA, 343 bp, Homo sapiens
  misc_feature 4, 11: n = A,T,C or G
gaanaaacccncttggaggaaaatggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctggagactggagaagtaattccaccaatgaaagaatttcccgatcaacatcattaaagattatgtaaaaagttaaaaggcttatgagcataagtttgttcctatattaccatatttactgaattttctggaaaagtaactttaataaagtttaatctcagaaattgg

SEQ ID NO: 25388 - DNA, 246 bp, Homo sapiens
actaatttaaaagttccagtatcctcaatatttgatgtcttatatgttcagaatcctttccagctgtaagtcatcagcaagtaaaaaatttagtatggcaatagttttcataagaggttttttaaaacagaaaaatgttgacattgccagcctctgggttgcattttgggatatgctacatttcaaaggtatcttttaaatctgaaggcaaagactttttcaacatctgaatattctgatttacag

SEQ ID NO: 25389 - DNA, 458 bp, Homo sapiens
  misc_feature 54, 56, 57, 449: n = A,T,C or G
aaaagcccaaggaataaattatcctgatatagcctctgatacatgttaccaggntnntacttctaagctggactttttagaaggaagtgcttcctgttaggtagaaaatttcacctctgctttttactagacctacagaccactgcaattgaggaacataaaaatgaaggatatccttcaactggtgcatagataaaccgtagtatatccatgcaatggaatcctactcagcaataaactaatgaaatacacatgcaaccacttggatgaatcttaaatgcattttactaagtaaaagaagccaaactcaaaaggctgcttactgtttgattccattcatattattttctcaaaaagcaaaacaatagggatggagaaaaaacttcagtggatgcaggggttaaggttggaatgctccttgactacaaagtggtagcatgaggaattgncttaataat

SEQ ID NO: 25390 - DNA, 458 bp, Homo sapiens
  misc_feature 2, 5, 52, 55: n = A,T,C or G
anccntagtaccgcaagggaaagatgaaaaattatagccaagcataatatanttnggactaacccctataccttctgcataatgaattaactagaaataactttgcaaggagagccaaagctaagacccccgaaaccagacgagctacctaagaacagctaaaagagcacgcccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagcaccaattaagaaagcgttcaagctcaacacccactacctaaaaaat

SEQ ID NO: 25391 - DNA, 238 bp, Homo sapiens
  misc_feature 11, 17: n = A,T,C or G
gtataaacccncctgtnaaatttttctggacaatgccagcatttggatttttttaaatcaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactac

SEQ ID NO: 25392 - DNA, 256 bp, Homo sapiens
  misc_feature 12, 22, 52, 55: n = A,T,C or G
aaacccgcagcnatgcatgttngattgaatgaaacaggaacgtatgggaagnctntgtggacaaatacggttacatgtagacaaatacggttacatggggcactaacatgaacaccagtgccagcaagaaagcaagcagcagagcaagtaagaacgggattttgaaaattcttatggaaaaaagtctgcagcatttccagaaactttcttaattagaagaaaacatgaaagtaaccgttgcaaatcaattgttttt

SEQ ID NO: 25393 - DNA, 450 bp, Homo sapiens
  misc_feature 8, 57, 365, 369, 390, 398, 449: n = A,T,C or G
aaacaggncctagcttatctagcctggaaggaatttgaagaggaggatttttaagtntaattaattaccttctgccccagggaaagggaaccaataaatatgcagagatatcatcctttgagttttgtaggttaaaaggtgatagagcagcttgtgttttctgggggagctggaggaagggggtatagatgatggactgtgataggaagttatttgttactttgtttgaaatactatattataaattccatgaatactttaaatgtgcaagtgtgcttaatgtcactattgagaacaaaatgtaaatggttgggcattctatggtacttcactggtctggtacagtgaatcttgccaactgcttnctgnatattaaattaatatcctgtnaccaaaantatgacagggaatactcttatactctgcattcagccaaagacagaataatnt

SEQ ID NO: 25394 - DNA, 466 bp, Homo sapiens
  misc_feature 58, 60, 271, 401: n = A,T,C or G
taaacatacccggggactgcgagcagaagcaacatcgctcgccatctgcaaaccaatntnattctattttgtgtcggtgctgtgggcgcctgtactctctctgtcacacaaccgtggtacctagaagtggactacactcatgaggccgtcaccataaagtgtaccttctccgcaaccggatgcccttctgagcaaccaacatgcctgtggtttcgctacggtgctcaccagcctgagaacctgtgcttggacgggtgcaaaagtgaggcangacaagttcacagtgagggaggcctcaaagaaaaccaagtttccctcactgtaaacagagtgacttcaaatgacaagtgcaatttacatctgtggaatagcattccccagtgtgccggaagcgagagctnaacagacaggaggagggaccacactggtggtaagagaaattaagctgctcagcaaggaactgcgg

SEQ ID NO: 25395 - DNA, 289 bp, Homo sapiens
  misc_feature 8, 44: n = A,T,C or G
aagattanctgccagactggcttatcaagacaaaggtgtccttnttaatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatg

SEQ ID NO: 25396 - DNA, 455 bp, Homo sapiens
  misc_feature 4: n = A,T,C or G
cccnactgggttcagtggtttgtgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactcctcggcatttctttctttgcacttcctgccggcattcttggctcaggttttgcattaaaagtacaagaacaacaccgccagaaacactttgagaaaagaaggaacccagctgcaacctcattcaagtgggttggcgtaagttacgcagctgatgagaaatctgtttccattgcaacctggaagccacacttgaaggccttgcacacctgcagc

SEQ ID NO: 25397 - DNA, 453 bp, Homo sapiens
  misc_feature 40, 48: n = A,T,C or G
atatcatgatattgattcaaagagagggattaagctgtcntgctaacntgtatggtagaaagagcactggataatttaaagtctggcaaatggcaaatcacttaatgtttttcactgcttttttctattttgaagtggagagaatacctaatccatatagttattgagctagtaaagtacatttatatatgtgtatatgtgtattttgtaaactttgaaaggcttcaatgtttaagatctcataaaaattagagaaccattctctgttaggatggattcataaggttactcctgaatatcatattatctccataaaaagcttagaattccctatactctgtgttttctataggaaatgaaaaaagttaaaaaaattattatttgtggactaggcgtggtggctcatcgctgtgatcgcagcactttgggaggctgaggtgggcaggatcactt

SEQ ID NO: 25398 - DNA, 460 bp, Homo sapiens
  misc_feature 5, 9, 55, 412: n = A,T,C or G
gaatngccnagccagcgcaggggcttctgctgagggggcaggcggagcttgaggnttccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggttctaaaacatgacggaggttgggatgaagctcttcatggagtaaaaaatgtatttaaaagaaaattgagagaaagggactacagagccccgaattaataccaatagaagggcaatgcttttagattaaaatgaaggtgacttaaacagcttaaaggttagtttaaaaagtgnaggtgattaaaataatttgaaggcgatcttttaaaaagagattaaccg

SEQ ID NO: 25399 - DNA, 229 bp, Homo sapiens
  misc_feature 30: n = A,T,C or G
tattagaaaatatttaaaagtgaattaaancaaaaatgcaacataccaaaacttcatagcatgcaggaaaaagcagcactgatatcgctgtaagcatttaaaaaataattacatttttgaaaacctcaaaaacagcagtctcatgtataactataagttaagaaactagaaaaagaataacaacctaaacccaaagctagcagaaagaaggaaataataaaaattagag

SEQ ID NO: 25400 - DNA, 460 bp, Homo sapiens
  misc_feature 2, 15, 56, 58, 333, 376, 399, 401, 448, 450: n = A,T,C or G
tnaaaacccaggganggaggagggtgcacataacccttaccctacctctgccaaantntgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggccattttagaccaaaatgtactgntaatgggttttttttttaaaattaaaagattaaataaaaaatnttaaataaaacatggcaataagngncagactattaggaattgagaagggggtcaactaaataaacgaagagngnccttccaaat

SEQ ID NO: 25401 - DNA, 451 bp, Homo sapiens
  misc_feature 25, 56, 60: n = A,T,C or G
aaaaagcccattaccagtgacaganttggacattatataggtgataagagggtcangttngacatggcaattcaaaatatataagcactagacaacagaacagcaggatacaggaaatcagataaatgaaaacaaagagaacacacagaaacaaaaaaatggcatacataagccctaacatgtaattacattaaatgtaaatgtacatttgcaaatataacaattaaaaatgagattggcagagtggattaaaagccaggtgctgtggtgcatacctgtaatcccagctactcaggaggctgaggcaggaggatcacttcagcccaggagtttgagaccagcctgggcagcatagcaagacccttactcaaaagaaaaagaaaaatgtcccaactctatgatgtctgcaataagttcatttcaaacataatgatacagacaggttaaatgt

SEQ ID NO: 25402 - DNA, 441 bp, Homo sapiens
  misc_feature 58, 60: n = A,T,C or G
aaaaaagacccttagttgtttaatttacatctctggaggagccaaaaataacaggacntnaccagacttaaactctacacatcagttttgaaacctaggtctccctctcttctgcaacacgaagggattgttgtttatttcctttgggtttgtcttgtctaaccctgctaattataaatttgagagaaattaggaaactaactttgggatttgatatatacaccttttgggaataagacatgttggaagacagttgttaaagacttctatgtagattgaaagctggagaaaaatctgatctctaaaagcattccttaaaattcatgacattggctcacgcctgtaatcccagcactttgggaggcaaggcaggtggatcacaaggtcaggagatcgagaccatcctgctaacacggtgaaccccgtctctactaaaaacac

SEQ ID NO: 25403 - DNA, 465 bp, Homo sapiens
  misc_feature 7, 8: n = A,T,C or G
taaaaannccctctccctactgctgctacacaagaccctgagactgacctgcaggactgttaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctgcacctgattttgtatccccctgtagcagcattactgaaatacataggc

SEQ ID NO: 25404 - DNA, 331 bp, Homo sapiens
  misc_feature 2, 50, 151: n = A,T,C or G
gngacgacctacgcacacgagaacatgcctctcgcaaaggatctcctttntccctctccagaagaggagaagaggaaacacaagaagaaacgcctggtgcagagcccaattcctacttcatggatgtgaaatgcccaggatgctataaaancaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggc

SEQ ID NO: 25405 - DNA, 401 bp, Homo sapiens
  misc_feature 7, 21, 27, 31, 91, 167, 318, 351, 365, 390: n = A,T,C or G
aacaacnagcctattgttttncaggangggncatcaaagctcagcgtagaaaacaacaaaacttctattacaagtgacatcggcatgcagntttttgaagggaggactcaaaatatcttattcagcacagactatgaaactcatgagtttcatttgccaagtggagngaaaagtttgaatgtcaaaaggcatctactgaaaggattaccagcaatgctaccagtgatttaaatataaaagttgatgggcgtgctattgtgcgtggaaatgaaggtgtattcattatgggcaaaaccattgaatttcacatggggtggnaatatggagtaaaggcggaaaacagtatcactnttaaatggatctgngatgggcagcaccacccggctaccnagttccttcag

SEQ ID NO: 25406 - DNA, 446 bp, Homo sapiens
  misc_feature 8, 9: n = A,T,C or G
gtgaacanntgcggtccctcacctgtgaagtggatgcccttataggaaccaatgagtccctggaacgccagatgcgtgaaatggaagagaactttgccgttgaagctgctaactaccaagacactattggccgctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaat

SEQ ID NO: 25407 - DNA, 293 bp, Homo sapiens
  misc_feature 24, 51, 57, 70: n = A,T,C or G
acattgacgcagccagcgcagggncttctgctgagggggcaggcggagctngagganaccgcagataagnttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagctcttcatggagtaaaaaatgt

SEQ ID NO: 25408 - DNA, 232 bp, Homo sapiens
  misc_feature 2, 15: n = A,T,C or G
tntcaacccgacatntaactctaattcctttcttttcaaaaaatttaactcatttcaggactctcaacacttcctaaaagaggagcacaaaggagagcaaattgttgctaagcttttcagagacagacccccagcatcagtgatattcaaggacaccaagatatggatgtaagattttgtttggatgggtaggagaaccagctctaaaaagaaggaatgctaggagaacaac

SEQ ID NO: 25409 - DNA, 448 bp, Homo sapiens
  misc_feature 2, 4, 42: n = A,T,C or G
cnantgcttcactagcaacctcaaacagacaccatggtgcantttgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctgctcacctggacaacctcaagggcacctttgccacactgagtgagctgcactgtgacaagctgcacgtggatcctgagaacttcaggctcctggcaacgtgctggctgtgtgctgcccatcactttggcaaagaattcaccccccagtgcaggctgcctatcagaaagtggtgctggtgtggctaat

SEQ ID NO: 25410 - DNA, 282 bp, Homo sapiens
  misc_feature 6, 10, 30, 46: n = A,T,C or G
tctgtnaatnctctgatcaaatatctgagngccaccactggctttngaagaaattacattatgacccagaagatggacctagatgaagacactgctgaaaaattttatcaaaagttactggaactggaaaagcacattagggtcactattcaaaaaacagatgatcaggccaggctcagtggctcatgcctataattccagcactttgggaggccaaggcagaaggatcacttgagaccaggagttcgagaccagcctgagaaacatagtgagcccttgtct

SEQ ID NO: 25411 - DNA, 295 bp, Homo sapiens
  misc_feature 3, 9, 27, 43, 51: n = A,T,C or G
gantaccanagtacctggcgggctggnagagcataagtacatncaggttgnctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgcattcaactcggaaactataagtaattctcaagaaagccctcatttttataacctggcaaaatcttgttaatgtcattgc

SEQ ID NO: 25412 - DNA, 467 bp, Homo sapiens
  misc_feature 10: n = A,T,C or G
tgaagaccanccaataatttaagacacatagaacagatttttttaatttatattttcatcctgaccagcttagttctaataatttttagttgtgagtgattaaaaaactttggatcaattttggtcaaacatgccaactttgtagtctgagtgacagggcaaggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggtcatgtaggctgctgaacagcacgcattacttgctcctgaagagtcccccattcatccatttggtccattagt

SEQ ID NO: 25413 - DNA, 473 bp, Homo sapiens
  misc_feature 1, 11, 60: n = A,T,C or G
ngaaccagccncaggagaggacgggacgcactgcacccactgtcatcacctaagaagacnggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatg

SEQ ID NO: 25414 - DNA, 211 bp, Homo sapiens
  misc_feature 3, 24, 29, 32, 82, 143, 164: n = A,T,C or G
gcnggagaaattttaagctaatgntagcnctnagagactctgcaactcatgagagcgaaagaattgtatttaaatcgcaaangagctgaaattcagggaaagatggaagatcttccagaacaagaaaaaaatataaatgttgnaggatgaattaggaaatgcanttttatgaaattcagttagaactatatgaagttaaatttgagatatt

SEQ ID NO: 25415 - DNA, 471 bp, Homo sapiens
  misc_feature 17, 19, 33, 49, 58, 59: n = A,T,C or G
gaacatgacctgtaaangngaactcgaatcctntttaaaaacaccctgnaaatgtatnnttgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacctctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagg

SEQ ID NO: 25416 - DNA, 462 bp, Homo sapiens
  misc_feature 4: n = A,T,C or G
ccantaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaacttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtcctctaacaaggacgccttccagcttcagcgatgttacttacgtttggatgctacttaaagtaat

SEQ ID NO: 25417 - DNA, 100 bp, Homo sapiens
  misc_feature 6, 16: n = A,T,C or G
caccangatctcgggntcggaacgagacttcacggattgttttaagaaaatggcagacaaaccagacatgggggaaatcgccagcttcgataaggccaag

SEQ ID NO: 25418 - DNA, 428 bp, Homo sapiens
  misc_feature 3, 23, 28, 29, 35, 46, 135, 286: n = A,T,C or G
ganagacggacatatacaccgantttcnnctatgncgccattctantactgcttccctaaagcagaaccgttattcatttaagaagtctaatgtgatatacattcatcctagtataaataaataatctctaagtnttctgaaatgggaatatttaacgccatagacagtggatatttactttaaatataatgttattaatcctctgcatttcttttatcttgataactcctagtgagggaatctaattaagatttcatgctgtctttgtaatgataaatgtttccnggactaaacactctataatacaaatcaaaaaatcttccttcttatactgagaaatgttcacccaaatttcctttggtattatatattattacacatgtgaattattattggttatttccaaggctgtattatcaattctaat

SEQ ID NO: 25419 - DNA, 344 bp, Homo sapiens
  misc_feature 3, 4, 35: n = A,T,C or G
tannctgatcagcgcatgggacatcttccaaggtngatcacatgttaggccataaaacatgactcagtaaatttttaaaaataaaaattatatcaaatatcgtctcaaaaaacaaaacaaaaaaacaaaccttttgaaatgaatgtaattggagacacaacatatcaaaacctgtagataccataaaggcagtgctaagagggaagtttataacattaaatgttaacttcaaaaaagagaaatactataaattaacaacctaatgtcacacctaaaggaactagaaaaataagaacaaactaaacccaaatctagcagaagaaaataaataacatatattcgag

SEQ ID NO: 25420 - DNA, 462 bp, Homo sapiens
  misc_feature 20, 27, 29, 138, 153, 216: n = A,T,C or G
gaaaaaaccggagtactttnaaaaacntngctggtgacagcaaaaatgacccatttatggaagcagctggcttcactgctcaggtgattatcctgaaccatccaggccaaataagcgccggctatgcccctgtattgnattgccacacggctnacattgcatgcaagtttgctgagctgaaggaaaagattgatcgccgttctggtaaaaagctgnaagatggccctaaattcttgaagtctggtgatgctgccattgttgatatggtcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtctccaagtctgcccagaaagctcagaaaggctaaatgaatattatccctaatacctg

SEQ ID NO: 25421 - DNA, 304 bp, Homo sapiens
  misc_feature 42, 56, 67: n = A,T,C or G
taaataacctagggctgttttttatattttggaaaaggcatngtttttaaagtaantataaaatggnaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctga

SEQ ID NO: 25422 - DNA, 123 bp, Homo sapiens
  misc_feature 98: n = A,T,C or G
ccctttcacattttccccattttgtgagcatttccttacttcctaacatgacaaaatatttcaaactaatcttgtattttccctgcccaatcctgatntcaaatatgtccccaaggagccttg

SEQ ID NO: 25423 - DNA, 468 bp, Homo sapiens
  misc_feature 16, 20, 30, 53, 185: n = A,T,C or G
gccctggccactgctnagancagacttcgntcgtactcgtgcgcctcgctttncttttcctccgcaaccatgtctgacaaacccgatatggctgagatcgagaaattcgataagtcgaaactgaagaagacagagacgcaagagaaaaatccactgccttccaaagaaacgattgaacaggagangcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatccatctggctggcagggaaaggaaagaacttgcatgttggtgaaggaaagaaagtggggtggaaagaagtggggtggga

SEQ ID NO: 25424 - DNA, 475 bp, Homo sapiens
  misc_feature 15, 43, 51, 165, 207, 223, 334, 335, 429: n = A,T,C or G
cagccagcgcagggncttctgctgagggggcaggctggagctngaggtttncgcagataagtttttttctctttgaaagatagagattaatacaactacttaaaaaatgtaggtcaatagggttactaagatattgcctcagcgttaggttctttaacgtaatcncaatagcttaagattttaaggagaaaatatgaagacttagangctagcatggaggaancccaagataaaaggtttctaaaacatggaagggagggttgagatgaagctcttcaatggggtaaaaaatgtatttaaaagaaaattgagagaaaggactacagagccccgnnttaataccaatagaagggcattgctttagattaaaatgaaggtgacttaaacagcttaaagtttagtttaaaaggttgtagggtgattaaaacnatttgaaggcggatctttttaaaaaggagattaaacccgagggggt

SEQ ID NO: 25425 - DNA, 443 bp, Homo sapiens
  misc_feature 2, 19, 37, 41, 49, 416: n = A,T,C or G
cnagagatgtctgcgctcngtggcctcagctggtggntttncgctactntctctttctggcctggaggctatccagcgtactccaaagattcaggtttactcacgtcatccagcagagaatggaaagtcaaatttcctgaattgctatgtgtctgggtttcatccatccgacattgaaagttgacttactgaagaatggagagagaattgaaaaagtggagcattcagacttgtctttcagcaaggactggctttctatctcttgtactacactgaattcacccccactgaaaaagatgagtatgcctgccgtgtgaaccatgtgactttgcacagcccaagatagttaagtgggatcgagacatgtaagcagcatcatggaggtttgaagatgccgcatttggattggatgaatncaaatctgcttgctgctttttaatatt

SEQ ID NO: 25426 - DNA, 388 bp, Homo sapiens
  misc_feature 3, 5, 136: n = A,T,C or G
atntnagattcaaagctaacttctgaagcataaacaaatctttactaggaataaggcttttcgggctcttttattaaagaagaggcgtacagaatctcgccccctgcctaataagttaaatgcaaatcagggtggntttgaaaatggtgagattggtgaatctgaggagaataatccacttgatgtccactcaatttatattgtcccttttcaatgtccaaagtgtgaaaagtgttttgaatcaagagcagattctcaatgaacacagctgtttgctgctagaagtggcaaaattccaagcaggtcaaaagaagctacaactataaaaccattgttaaaaaaatcttgccaagcttaagcgtgctaggagtaaaaaattagataactt

SEQ ID NO: 25427 - DNA, 442 bp, Homo sapiens
  misc_feature 2, 15, 25, 38, 39, 40, 42, 44, 47, 57, 59, 63, 65, 66, 173,183: n = A,T,C or G
anctgtcccaggtgncgcgagaganaccgactgtttcnnnananggnctttgacgantngaangnngaagatgacatcacctattggcttaacatgagatcgaaatgggacatgaatactatggcgattactaccaacgtcactatgatgaagactctgcaattggtccccgnagcccctacngctttaggcatggagccagcgtcaactacgatgactactaaccatgacttgccacacgctgtacaagaagcaaatagcgattctcttcatgtatctcctaatgccttacactacttgggttctgatttgctctatttcagcagatcttttctacctactttgtgtgatcaaaaaagaagagttaaaacaacacatgtaaatgccttttgatatttcatgggaatgcctctcatttaaaaatagaaataaagcatttggc

SEQ ID NO: 25428 - DNA, 234 bp, Homo sapiens
  misc_feature 7, 21, 31, 35, 37, 39, 42, 47, 48, 56: n = A,T,C or G
aaaagtncctgctgaaatttncgttgtgtcntatngntnctntaggnntgtgttcntaagatgcttaaaatttttatcatgaaaaatcctattttctctatacccttcctgtactgttctattttggaaccagagaatcaataactggcttggtaatgagctcattgtccttaacttttgctttattgattcacaatacgcttactgaaatgtaataaactattcataaacttg

SEQ ID NO: 25429 - DNA, 466 bp, Homo sapiens
  misc_feature 6, 11, 139, 151, 197, 217, 276, 277, 323, 329, 346, 419: n = A,T,C or G
cagcgnagggncttctgctgagggggcaggcggagcttgaggtttccgcagataagtttttttctctttgaaagatggagattaatacaactacttaaaaaatatagtcaatagggttctaagatattgcttagccgtnaagtttttaacngtaattttaatagcttaaggatttaagagaaaatatgaagacttangaagagtagcatggaggaanggaaaagataaaaggttctaaaacatgacggaggttggagatgaagccttcttcatggnngtaaaaaatgtatttaaaagaaaattggagagaaaggactacaganccccgnattaataccaatagaangggcaatgcttttagattaaaatgaaggtgacttaaacagcttaaaggttagtttaaaagttgtaggtggttnaaaataatttgaaggcggatccttttaaaaaagaggattaaaccgga

SEQ ID NO: 25430 - DNA, 163 bp, Homo sapiens
  misc_feature 13, 18: n = A,T,C or G
tcaacaatagggnttacnacctcgatgttggatcaggacatcccaatggtgcagcccgctattaaaggttcgtttgttcaacgattaaagtcctacgtgatctgagttcagaccggagtaatccaggtcggtttctatctacttcaaattcctccctgtacga

SEQ ID NO: 25431 - DNA, 414 bp, Homo sapiens
  misc_feature 13, 24, 50, 106: n = A,T,C or G
gtctaaaatcttnggtctgaggcngaatttcatactgagtgagcctctgngttcagtagccatcacccaggtgcagctgcattgtaattatgatgcaacaactagnctaggggcatatgtgatggtttatctgctgcaccgtgacagccctggctgtgactcccacatccctcaggagcacctgagccaagtgcctttggggatttatggactagataaacttttagatccctttcatcttttagcttttcggtataacatggggaacatggggttcttttgggttttctttaagcaatatccagtgtttggtttctatgaatattcaagagcaaactaaccaaaacatcaaggaaaccattttcgagactttaatacctggcatatgaattatatatgaaggctcgagttgga

SEQ ID NO: 25432 - DNA, 216 bp, Homo sapiens
  misc_feature 17, 18, 32, 37, 57, 60, 199: n = A,T,C or G
aacaaggccctgggatnnctagaggataaacntcctncatagaggacatacctttgnttnaaggagctgccgtcaggtgggaatgagatctcgaaaccaaggtggtgaaagtgcatcttgatgggcatatctcctgtcccaagccctccatcatcggcaatgctggtgaaaaaagtctctcagaagatgcaaaaaagangaaagaaatcaaatagg

SEQ ID NO: 25433 - DNA, 284 bp, Homo sapiens
  misc_feature 9, 11, 58: n = A,T,C or G
aaacttacncnagaaaggactctgcctgagctaggattgagcctgggccaccattgtnaaatggcggaggctaaacaaagcattgccacatggttacaggtcacacttccaaggacgtaaaacaagatggaggcctgcagcaaagtttgctactgaccatacagaaagacatgcaaagcacaccagattggctaaagcttaagcccaacctcacaaatcctttttcataactaaaactttacagagaaagaagaagcagttttccttatcattcttggtctagc

SEQ ID NO: 25434 - DNA, 469 bp, Homo sapiens
  misc_feature 21, 50, 68, 414, 467: n = A,T,C or G
aaattgcccagccagcgcagngtcttctgctgagggggcaggcggagctngaggttccgcagataagnttttttctctttgaaagatagagattaatacaactacttaaaaaatatagtcaataggttactaaggatattgcttagcgttaagtttttaacgtaattttaatagcttaagattttaagagaaaatatgaagacttagaagagtagcatgaggaaggaaaagataaaaggtttctaaacatgacggaggttgagatgaagcttcttcatggagtaaaaaatgtatttaaaagaaaattggagagaaaggactacagagccccgaattaataccaatagaagggcaatgcttttaggattaaaatgaaggtgacttaaacagcttaaagtttagtttaaaagttgnaggtgattaaaataatttgaaggcgatctttttaaaaagagattaaacccgangg

SEQ ID NO: 25435 - DNA, 102 bp, Homo sapiens
  misc_feature 1, 17: n = A,T,C or G
ngtccaactgtggtgcnttggaatgaaacggaagtgaacatgagcccagctgagagaggagcagggaatgtgtgaaaaacagctgctctccttgtccagctt

SEQ ID NO: 25436 - DNA, 214 bp, Homo sapiens
  misc_feature 1, 6, 44, 133, 157: n = A,T,C or G
nacctngatttgtgctaaaatgaagactctgcagtctacacttntcctgttactgcttgtgcctcttgataaagccagcaccaccaacccagcgggactcacgcattatctatgattatggacagataatttngaagaatccatatttagccaagantatgaggataaatacctggatggaaaaaatattaaggaaaaagaaactgtgataata

SEQ ID NO: 25437 - DNA, 353 bp, Homo sapiens
  misc_feature 27, 38, 40, 49, 51, 145, 148, 151, 314, 316: n = A,T,C or G
accacgaaaaatacctaaatgctgtanacaatttcacngnaataagcantnggcccaaaagcctaggagtttttttgtacttaagtgaatctggtatgcaacagagatgctgcagctgatgcctctaaaaggtattcatcatggnacnctnaggcccgtgcttggtgttccagagcccagggttgagcatcctgaaggagccactgcagccgtcactgccccagagcctgtggagatagagcctgttcgctgctttttcttcccgctcttaagacatggctggagctcagtcttcattgaatgaagcccgctgngncattgcatagccttgctttcttgaactaaactgtttg

SEQ ID NO: 25438 - DNA, 305 bp, Homo sapiens
  misc_feature 8, 57, 75, 92, 274: n = A,T,C or G
aatctgcnggctcttcgtcagattgggcagaggacgataagcactgcttcccgcagncattttaaaaataaagtnccggagaagcaaaaacngttccaggaggatgatgaaattccactgtatctaaagggtggggtagctgatgccctcctgtatagagccaccatgattcttacagttggtggaacagcatatgccatatatgagctgcttgtggcttcatttcccaagaagcaggagtgacttcagtcatcccagcaatcgcttggtcagnttcattcagctctctatggaccagtaatctg

SEQ ID NO: 25439 - DNA, 467 bp, Homo sapiens
  misc_feature 6, 56: n = A,T,C or G
aaattncccagccagcgcaggggcttctgctgagggggcaggccggagcttgaggntccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagctcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtg

SEQ ID NO: 25440 - DNA, 458 bp, Homo sapiens
  misc_feature 10, 16, 58, 416, 420: n = A,T,C or G
aaagagaccnatcttnatggctcacaaaacctaaaatgtttactatatggtcctttgncaaaagtttgccaatcctgatctaaggtaaaatttgaggactttccaacctaagtaattgagggaagagttattaacccagtagcaaattcctaaggagctaagcattcccaagttaaacttggattgcacatattttcacatatgcaaacatatacaacttgaaggaggagcttcaccagtgtttcatccttggaaaagcctttatgttctgttacgagcccaggcttccactaggaattagcccaccaactccacttagttactatgtcaccttgggttatctaagactaaatgaaaattatgtttttggtaatgcttcaagtttgcccaccatcaccatttaagggaaaactatnaaangggcttctgaccaatcatacattttttagaatctaggc

SEQ ID NO: 25441 - DNA, 468 bp, Homo sapiens
  misc_feature 11, 23, 31, 36, 49, 56: n = A,T,C or G
aagttcccgtntagcggaagcantattttgnaaggnaatgatacctaanccatagnttctcgaagttgtgcacattgcaaggaagataaacaaaaagaaatctacacctaactacatcataataaaactgcaagaaaccaacgaaaataggaaagtctaaaagcagccacaagggaaaaaaaatacgttcagaaaagtaatgattagactaacagctgacttcaaaacagaaaacttagtggatgagtttagcatcagattagacatacttgaaaataagtgaactggaagatggcttagaaggagagatctggaatgaagcttcaagacacagtattacagaagaaaggaaaagatatagactatacatcgaaaagttttcgcaaaaattggaataatgaaaggagagggaaagttacatgtatagcagaagcagtattttaaaaggaaatgatccctaaaccatag

SEQ ID NO: 25442 - DNA, 409 bp, Homo sapiens
  misc_feature 2, 47: n = A,T,C or G
tnctctacagatggtaaaatgcaaggaattgccacaagcagtctgtnagatccttgggcttcaaggcagtgaagttacaacaccagatccagacgttggtgaagacgaaaatgttgtcatgactccttgtcctacatctgcatttcaaagtaatgccttgcctacactctctgccaggtggagccaggaaatgacagcccaacacagataccagtgtcctcagatgtctgcagattaacacctgcatgatcactgttcttgctttttttgggaagagacactttgttgcaaccctttttcaagtacttgaaagttgaaaatttgaaatcttggtattgatcatgctttaaggtttatgtaaagaaagtgacctgatgttcttacattaaagctttacaaagatttaaac

SEQ ID NO: 25443 - DNA, 392 bp, Homo sapiens
  misc_feature 6, 15, 74, 117: n = A,T,C or G
ggcagnctggagctngacctttcccgcagataaggttttttctctttgaaagatagagattaatacaactactnaaaaaatatagtcaatagggtactaagatattgcttagccgtnaaagtttttaacgtaattttaatagcttaagaattttaaagagaaaatatgaagacttagaagagtagcatgaggaaggaaaagataaaaggtttcctaaaacatgacggaggttgagatgaagctcttcatggaggtaaaaaatgtatttaaaagaaaattggagagaaaggactacagagccccgaattaataccaatagaagggcaatgcttttaggattaaaatgaagggtgacttaaaccagcttaaaggttagtttaaaaggttgtagg

SEQ ID NO: 25444 - DNA, 307 bp, Homo sapiens
  misc_feature 10, 283, 298: n = A,T,C or G
actctactgnacttccttgaagatgaaaaatatgaagaggttatggctgccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagangagtaaaggacccangaaaactgc

SEQ ID NO: 25445 - DNA, 384 bp, Homo sapiens
  misc_feature 1, 3, 41, 49, 55, 58, 151, 262, 278, 365: n = A,T,C or G
ngnacccaatgattaacaaaggcgtccgaagaaatcgttgntggaaggngaccanggnggaaagagacgttgctttggccctgcaagtaagaagagagagggaatagcctgaaggagtaacactaaatttaaaatgacacttttttaccanccagcgaaagcagatgttcaaaggggatattggccagagtctgcacactaagatgagaaatgtcccttcttcctgaaggtgtctgatgtgtaaaaatatgatatactttgntgctggttcctccttnccttttgcatattattctgaaacaacattaactagtacttgcgcattgaagggatgcacttccctctatgttaggagtgaataaaantaaaaataggatccttata

SEQ ID NO: 25446 - DNA, 250 bp, Homo sapiens
  misc_feature 10, 16, 40, 137: n = A,T,C or G
ccactgcacncaccanacttcgctcgtactcgtgcgcctngctttttttttcctccgcaaccatgtctgacaaacccgatatggctgagatcgagaaattcgataagtcgaaactgaagaagacagagacgcaaganaaaaatccactgccttccaaagaaacgattgaacaggagaagcaagcaggcgaatcgtaatgaggcgtgcgccgccaatatgcaccgtacattccacaagcattgccttctta

SEQ ID NO: 25447 - DNA, 163 bp, Homo sapiens
  misc_feature 9, 11: n = A,T,C or G
tactaaaantncaaaaattagctgggcgtggtggtgcatgcctgtaatcccagctacttgggaggctaaggtaggagaattacttgaacatgggagatggaggttgcagtgagccaagatcatgccactgcattccaacctgggcaagggagtgagacgctgt

SEQ ID NO: 25448 - DNA, 447 bp, Homo sapiens
  misc_feature 3, 15, 39, 40, 53, 75, 76, 88, 89, 91, 146, 198, 203, 208,242, 245, 327, 329, 337, 379, 407, 412: n = A,T,C or G
cantaggtcacgatntttagctcacatctggaagcagcnnctacttggctcangtacatataagagtaattagtnntattctctcttnntnataaaatcgggtttcagatgagatgtttatcttagactattttagggaaaaattntacatgtttgagatggtggagtaaaaaagactgttaaacatttcttttaaanaattnttttnacattacaacaatatatttatgatgtgctcagancanaaatttaactcctgtgcccagatctactttcaaagtgagattttcactcgcagcttaaatttctgactagactaacatttgngnatttttgngcctaggccgggatcaaatttcacagtggattttgaagttgnccctaaatttggataaaatcaagtgatnaagtnctaaagagataaaatggtaatttccattttaaaag

SEQ ID NO: 25449 - DNA, 445 bp, Homo sapiens
  misc_feature 1, 11, 25, 30, 32, 71, 341: n = A,T,C or G
naaaaaatccnatatggagtcagtnctgcntntaatgtcttgaacattttaaattacttctattaccacgntgttttttagtagaattgtttcctaaagaaaaccactctttgatcatggctctctctgccagaattgtgtgcactctgtaacatctttggttgtggtagtcctgttttcctaataactttgttactgtgctgtgaaagattacagatttgaacatgtagtgtcgtgctattgagttgtgaactggtgggccgtatgtaacagctgccaacgtgaagatctggtacttgatagcctcttaaggaaaatttgcttccaaattttaagctggnaagcactggaataactttaaaaaagaattacaatacatggctttttagaatttcgtacgtatgtaagatttgggtcaaattgaaatgctgtctgatcctcaacc

SEQ ID NO: 25450 - DNA, 272 bp, Homo sapiens
  misc_feature 2, 6, 271: n = A,T,C or G
gncgtncatatacatcatgttttattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttagaatatattctgaatgaaaactgtattgaggattcatttttgnt

SEQ ID NO: 25451 - DNA, 468 bp, Homo sapiens
  misc_feature 1, 8: n = A,T,C or G
naatgaanccacccccactgaaaaagatgaagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctgcaacttagaggtggggagcagagaattctcttatccaacatcaacatcttggcagatttgaactcttcaatctcttgcactcaaagcttggtaagatagttaagcgtcataaagttaacttccaatttacatactctg

SEQ ID NO: 25452 - DNA, 295 bp, Homo sapiens
  misc_feature 7, 12, 252, 265: n = A,T,C or G
tgttatnccagnactttgggaggctgaggcgcgtggatcacccgaggtcaggagttcgagaccatccagcctgactaacatgttgaaacctcgtctctactaaaagtacaaaaattagctgggtgtggtggtgcatgcctgtagtcccagctgcttgggaggctgaggcaggagaatcacttgaacctgggaggtggaggttgcaatgagccaagatcacaccattgcgctccagcctgggcaacaagagtnaaactccgctttnaaaaaaaagagagagaattcagcctaagtg

SEQ ID NO: 25453 - DNA, 464 bp, Homo sapiens
  misc_feature 8, 21, 59, 388, 422, 430: n = A,T,C or G
gaaaaaancccgcagggaggnatttaacagctgagcaaaaacattgagtcactctcatnggacacgaggcccttggcagggaatatttaaagcaacttcaagtttaaaatgcagctgttgattctaccaaacaacagtccaagattgccatttcccatgagccaactgggaaacatggtatatcatgaagtaatcttgtcaaggcatctggagagtccaggagagaaagactcacctctgtcgcttgggttaaacaagagacaggtttgtagaatattgattgggaatagtaaatcgttctccttacaatcaagtcttgccctattcggccttatacatctggcttacaaagaccaaagggatcctgcgcttgatcaactgaccagtntgccaaaaccaggcatccaatttgtaaccaattntgataaanggacaaaatagctggtttgccacctcaaaacttt

SEQ ID NO: 25454 - DNA, 464 bp, Homo sapiens
  misc_feature 21, 57, 408: n = A,T,C or G
taatgtgccagtcacagtggnaactgcagggaggaggtgtgttcctaagaaccaaantccagcacagcatcctgtgaagccacgtgtaatgatggtcccataaggaaagtatgtgaatatggctcttgtaaaggattaactattgtaattttagcttatgctctgtattctgttttctatggaattatttaagcccttttagtgacctttgtcctgcccatttaaaaactaaaatgtagtatatattgtataaaatggaaatatcattattgcttcattaggggaaactgtcataggcattgaaagaagggtaaaagcaagcagttttatcaggcaattgtaaaacaccaaaaatatagattcgctttgacgtgtaacacactaaatgtattttgtacagcatctggnttaaaaggtgccttaagagtttaccattacttgcttggtctatatacagattatgt

SEQ ID NO: 25455 - DNA, 461 bp, Homo sapiens
  misc_feature 13, 14, 33: n = A,T,C or G
acccgaaggcgcnnaaagcgaagaaggaagctnctgcccctcctaaagctgttccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggcaaggtcaacaccctgattcggcctgatggagagaagaaggcatatgttcgactggctcctgattacgatgctttggatgttgccaacaaaat

SEQ ID NO: 25456 - DNA, 366 bp, Homo sapiens
  misc_feature 12, 13, 52: n = A,T,C or G
atccctaaagtnnggattgggacttttcaggtccttttttggagggcaaagnaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtctataagcaaatgaattaaacagctatgc

SEQ ID NO: 25457 - DNA, 458 bp, Homo sapiens
  misc_feature 30, 36, 58, 322, 402: n = A,T,C or G
aaataaaccaactgaagattctgagagatnaactgntcaagtcttagcaatgatactncacttctctttgacaggttctgggcttaagttagaggccctactggttccaaaccatattccactgactttgcaagtaaaataaatttgattctgaaataggaaacaaaaaaaggagaaataaccgaatagtagaagaaaaactgtttgtaggaagacgatgcatggaatgatgtggacattgagtaaccatgtcaataaaatatataaaccaaacttaaatttgtgaaataaggaagttggtcctttggtggtacagtgtatnaaaacaatttcgggactgctgtgcaaaagacatatatagtttgcttcctctggggtaagccggttatattcaggttcagntttacttctaagttgccttgtaattgggactgggttcagcatcacaaaacccaatt

SEQ ID NO: 25458 - DNA, 350 bp, Homo sapiens
  misc_feature 4, 13, 326: n = A,T,C or G
ccgnaaatgctcnagaagagttaactattctaaatgtatgttgcaccctatacaggagcacccagattcataaagcaagttagagacccacaaagagacttagactccaacacgataatagtacaataatagtgggagactttagcaccccactgtcaatattagatcaacaagacagaaaattaacaagtatattcaggagttgaacttagctctggaccaagcagacctaatagacagctcagaactctccaccccaaatcaacagaatatacattcttctcagcacttcatagcagttattctaaaattgccacataattggnagtaaaacactcctcagcaaatgc

SEQ ID NO: 25459 - DNA, 459 bp, Homo sapiens
  misc_feature 10, 56, 263, 291, 427, 433: n = A,T,C or G
aaaaaagccncgggctgctaacgaagtcactcttaattaatatctgtatcctggancaatattttatgggtatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagacccacacatatacacgaatagacatcaaactcaatgcttaatttgnaaatttaggggttttttatttctactgncaaatgatgtgcaaaaccttttactgggtgcatggaaatcagccaagtttataatccttaaatcttaatggtcctcaaaagctgggattaaatcatatggatggtactctctgccccaaatatcttgatccattcnaattgnctggtaaaaataaggggggagatatt

SEQ ID NO: 25460 - DNA, 460 bp, Homo sapiens
  misc_feature 57: n = A,T,C or G
taaatgtcccacatcttgacgaggctgcggtgtctgctgctattctccgagcttcgntatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctcctggccagggcagcccttcaggagctccttagtaaaggacttatcaaactggttcaaagcacagagctcaagtaatttacaccagaaataccaagggtggagatgctccagctgctggtgaagatgcatgaataggtccacccagctgtacatttgg

SEQ ID NO: 25461 - DNA, 301 bp, Homo sapiens
  misc_feature 1, 11, 63: n = A,T,C or G
naaagctaacngagcacacccgtctatgtacgcaaaataagtgggaagatttatagggtacgnggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactac

SEQ ID NO: 25462 - DNA, 267 bp, Homo sapiens
  misc_feature 59, 60, 177: n = A,T,C or G
acaatgagccttcaagatctggtcactatggtaccgagaacgaaaatgcatattatgcnncatcgtgtacagctcaaaaaaggagatggacgaacacatgcggagcatgttgcatcacagggaacttgagaacctcaagggcagggacattagtcatgagtgccgagtgtgcggggncacagaagtgggtctttctgcatatgcaaagcacatttctggccagttgcacaaagataacgttgatgcccaggaaagagaagatgatgg

SEQ ID NO: 25463 - DNA, 467 bp, Homo sapiens
  misc_feature 1, 3, 57, 439, 440: n = A,T,C or G
nanaagtccctgttgattgagagagaaagacttctttaaaaaagcgtttttgttaanttagtctgggaatcatggaatcatagtgaccagtaactgttatggactggattgtatccccctccaattcagttatggtgctgcttcagaaagaaaagagatagtttcccttgcaaagttatcaaagtgctccccagaagacattaggtatttgctttctagtctacatacaatgaaaaggaaaaaacgtcagttcctgaagctctctcaaaacatcaacagatggaaagacgtgcccatgtcctcccctccctccactctgggggcttggaaatgctgcagcagggagcaggccccaggctggacctgccctgtcctcacgacgagtgtgtgcaaaagtgaacaataaatcatttcaaagatgcaaggaagaaaaaccaanncatcaacagaatcttctttcccataat

SEQ ID NO: 25464 - DNA, 454 bp, Homo sapiens
  misc_feature 4, 11, 27, 43, 45: n = A,T,C or G
cgtncggtccngagatgcctcgctccngtggccttagctgtgntngcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggatcgagacatgtaaagcagcatcatggaggtttgaagatgccgcatttggattggatgaattccaaattctgcttgcttgctttttaatatt

SEQ ID NO: 25465 - DNA, 334 bp, Homo sapiens
  misc_feature 30, 56, 58, 287: n = A,T,C or G
ataatgaaccaactagaaataaccttgccnggagagccaaagctaagacccccgantntagacgagctacctaagaacagctaaaagagcacacccgtctatgtagcaaaatagtgggaagatttataggtagaggcgacaaacctaccgagcttggtgatagctggttgtccaagatagaatcttagttcaactttaaatttgcccacagaaccctctaaatccccttgtaaatttaactgttagtccaaagaggaacagctctttggacactaggaaaaaacctngtagagagagtaaaaaaatttaacacccatagtaggcctaaaagcag

SEQ ID NO: 25466 - DNA, 401 bp, Homo sapiens
  misc_feature 10, 384: n = A,T,C or G
cctgagatanacaaaatatgggcatgcatgctaaagggaaaatgtgtgcttggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgtcactatcacaaaatcatctatatttatagaggaatagaagtttatatatatataataccatatttttaatttcacaaatnaaaaattcaaaggtttg

SEQ ID NO: 25467 - DNA, 459 bp, Homo sapiens
  misc_feature 5, 449: n = A,T,C or G
aaagngcccacatagatttaagtgaatacattaacggtgctaaaaatgaaaattcttacccaagacatgacattcttagctgtaacttaactattaaggccttttccacacgcattaatagtcccatttttctcttgccatttgtagctttgcccattgccttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtggcttccccaggtggcctggaggtggcaaagggaagtaacagacacacgatgttgcaaaggatgggtttgggactagaggctcaagtggtgggaagagatccctgcagaacccaccaaccagaacgtgggttgcctgangctgtactga

SEQ ID NO: 25468 - DNA, 438 bp, Homo sapiens
  misc_feature 2, 3, 35, 66, 366, 421, 429: n = A,T,C or G
gnnagtgtcataagaactgttttgggtgatttaantggtatataagccttggctgtgatatttggnacattctaagtctattacaatcttaccatggtgaagtatgatctaatacatgataatcctctatacaagcagtttccacgcacattaaatttttaaaatcccaccactggtaggatgtaattattttacataatgaatttttcgctattctctttcctgatacccttcagtgatcaagagaaagcatttccaagataagatttgagaaacagagtaaagttaaatagcctataataagataaaaaagtaacctcttaacactatcttttcatttgccaactttaacagcacctacatgtnatggatataaaataacaaatgtccattacctagtacgacaccaagagcatctggntaagatcncagaatatt

SEQ ID NO: 25469 - DNA, 415 bp, Homo sapiens
  misc_feature 2, 10, 55, 407: n = A,T,C or G
tnaatgaccnatgtaagacttgacagtggaactacattagtacacagcaccagantttatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcgggaatcctgtcgattagactggacagcttgtggcaagtgaatttgccttgtacaagccagattttttaaaatttatattgnaaatattg

SEQ ID NO: 25470 - DNA, 407 bp, Homo sapiens
  misc_feature 8, 57, 59, 377: n = A,T,C or G
aaaaacanccgccttgcctctatgagatcaaacagtttccggagtgtgcccagaacntnggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctggtatgttatgattttattctttgngagttaattagaataaagtcattttcttcg

SEQ ID NO: 25471 - DNA, 274 bp, Homo sapiens
  misc_feature 2, 12, 28, 42, 48: n = A,T,C or G
cntatgaggaancctagagcagccaggngaggctctccagtntaatanaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaaccctcca

SEQ ID NO: 25472 - DNA, 404 bp, Homo sapiens
  misc_feature 150, 358, 360, 370, 396: n = A,T,C or G
cagccagcgcaaggggcttctgctgagggggcaggcggagcttgaggttccgcagataagtttttttctctttgaaagatagagattaatacaactacttaaaaaatatagtcaataggttactaagatattgcttagcgttaagttttnaacgtaattttaatagcttaagattttaagagaaaatatgaagacttagaagagtagcatgaggaaggaaaagataaaaggttctaaaacatgacggaggttgagatgaagcttcttcatggagtaaaaaatgtatttaaaagaaaattgagagaaaggactacagagccccgaattaatccaataggaagggcaatgctttttagantnaaatgaaggngcctttaacaagctttaaggttttgnttaaaggt

SEQ ID NO: 25473 - DNA, 429 bp, Homo sapiens
  misc_feature 14, 18, 53, 397, 428: n = A,T,C or G
atgcctctaagatntggnttgggatcaataggaaagcatatgcagccaacctngatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataaagaggaatttggtataattatggtgggtgattattttttatactgtatgtgccaaagctttactactgtggnaagacactggtttaataaaaggattacattnc

SEQ ID NO: 25474 - DNA, 436 bp, Homo sapiens
  misc_feature 4, 6, 309, 409, 432, 435: n = A,T,C or G
tgtntntactaggtgcaacttgtgaagttttaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatgggagaaacgacacaggntaggagacgtcgctttgaacgtgctataggacccttctcaaacacacaccatcagaattcaatatttccctgccagactggcttatcaagacaaaaggtnccctcataatggaagtaaagcgngtnt

SEQ ID NO: 25475 - DNA, 352 bp, Homo sapiens
  misc_feature 11, 28, 56: n = A,T,C or G
taaataaccgnccaacaatttaaaaagntgaaaatctcttcacattagaaatttanttttatttggaatttagattgatagaccatgtatggatttttgaagtattttataaggactgatgttgtgacaagttgaataatttgatgcctttgagtcttaatgagaatcttgttaatactaataatcatctagagaagatagtcttttttggttaggatcagcaacagctaaagatgttaaagaggttctaaatcttggtggaagttattataaagttataacattgtttcctaagtaatggaaagaaagacccaaaatttaatgagagtaataaatgtaaaattaactaaag

SEQ ID NO: 25476 - DNA, 317 bp, Homo sapiens
  misc_feature 7, 26, 58, 278: n = A,T,C or G
taaagtntccctttaaaaggaaccgntgtccatttaaaggtttcatagttatcttcantgggttagtattgtttggggcaggacattaaactagaagggattctataggatgaggtgatacctagaaggtaatatattgtaaggcaaaagagattagaagaaatggggaaaggatagtaaaaggcaagtcagattaaaggttgaaacatgaagatattctcaattgtatttctgcctatgtttgcttttttggctcaagcatctgttggaagagacanaatgtgacttggttcataataaagcaagaattatttact

SEQ ID NO: 25477 - DNA, 181 bp, Homo sapiens
  misc_feature 19: n = A,T,C or G
caggcggagcttgaggttnccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatg

SEQ ID NO: 25478 - DNA, 226 bp, Homo sapiens
  misc_feature 35: n = A,T,C or G
cacacggacacagggatgagatcaacacacactgnggcctgatgcaggggccggtagcggggagagcatcaggataactagctaatgcatgtgggggcttaatacctaggtgataggttgataggtgcagcaaaccaccatgggacacgtttacctatgtaacaaacccgcacatcctgcacttgtatccagaacttaaaatattttaaaaatctttagagaatac

SEQ ID NO: 25479 - DNA, 448 bp, Homo sapiens
  misc_feature 3, 21, 27, 32, 33, 34, 36, 42, 147, 403: n = A,T,C or G
gancgagaagaatgctgctgncaaagnggacnnncnaacgantttaccacctgtccttcgagcaggagttaacaccgtcaccaccttggtggagaacaagaaagctcagctggtggtgattgcacacgacgtggatcccatcgagcnggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtcgtggctcgtatcgccnagctcgaaaaggcaaaggctaaagaacttgccactaaactgggtt

SEQ ID NO: 25480 - DNA, 442 bp, Homo sapiens
  misc_feature 4, 13, 38, 132, 390, 420, 441: n = A,T,C or G
tganaaaggggtnatgtcatcatttgatgcagagtccntttttctctataataaatccctttgccaaatgcatgagttgcagacttgctactggcaagagtgaagcaagtgggtgagtaaaactattttgangtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggatcttggtaaactgaagacttttatttgggaatgaaaaaccntaaaaaaaatctctttaatcgttgaactgngcatttccctggatttttccnt

SEQ ID NO: 25481 - DNA, 458 bp, Homo sapiens
  misc_feature 4, 393: n = A,T,C or G
aatnccaccagcattcctcaaggtcttcctccttcccttacggaattacatcttgatggcaacaaaatcagcagagttgatgcagctagcctgaaaggactgaatgatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgccacctggacacaacaccaaaaaggcttcttattcgggtgtgagcttttcaagcacccggtccaagtactgggagatcagccatncaccctcaagatgtgtctacgtgcgctctgccattcaactcggaaactataagtaattctcaaga

SEQ ID NO: 25482 - DNA, 359 bp, Homo sapiens
  misc_feature 6, 8, 37, 38: n = A,T,C or G
catgangnccaacatcgagcagatttttaggtctttnntggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaaggagg

SEQ ID NO: 25483 - DNA, 476 bp, Homo sapiens
  misc_feature 10, 452, 454: n = A,T,C or G
ccagcaaganggatgcttaagggagtgatggtgttgatatcaggagcttacattcactctaatcttgttttataattagctttataatgcacgaccacaaatttggcagattcatatagtccctaaattttccattttgaatcactatcatatcaattatattaaagagatattcctgattgtgtgcttgttttactgatactttatgcacattatattagtactgattaatagatttttttctggactagaactttcttgatcattctgtatgaaattattgcaaagatagaaaaggaaacacttgttttgcttttcaattataaagcatcagtggtaccttggtgacatcgacaaaacaatagctgtcacattcaatcatctgcaaaatctgacaaatattaattatattgattttctattggcttatggagggagggctctttatccangngcagaaaggtaattatatactt

SEQ ID NO: 25484 - DNA, 495 bp, Homo sapiens
  misc_feature 2, 6, 53, 434, 462, 492: n = A,T,C or G
gnaccngttattttcagtacatgggtaacacccaggccctttcccattatatncaggtatgctacaagttcttttaactcttatcagaagttattattactgtttccttagagaggctaccaggctaaaattcacttagtttggtttgtctaatgtcctcattattttatcctgaagatgatgtcatttctcaggacttgaaaatgacttggctgaactaaaggtaaaaaagccaagcctctgtcacttttcctagactcctaggcacagctatggagtctttgcacagtgcccataccctaaaaattaataatgaaaaccaaacctcaagaacctagagcagctctctacttgccaccatggactccagtggcaagcataagaaaagcagataggtgcattctatttaggttatagctgctttggtcctttgnggttcactaagcagaggctcaaaaattnccttgatacttcagctgccctggtcttttnctc

SEQ ID NO: 25485 - DNA, 495 bp, Homo sapiens
  misc_feature 6, 8, 194, 333, 355, 372, 418, 451: n = A,T,C or G
ctgtgngncaggtttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagngtttttttatttctactgcaaatgatgtgcaaaaccttttactggttgcatggaaatcagccaagttttataatccttaaatcttaatggtcctcaaagcctgggattaaatcatatggatgtactctcttgcccaaantatcttgatacattcaaattgnctgggtaaaaaataggnggagatattgaggccaagaatattgcaaaatcgtgaagctcatgcncttaagaagttttttagaataagaatttgcatnctacctagggaactttctagaatattttcaccctaagccagggt

SEQ ID NO: 25486 - DNA, 486 bp, Homo sapiens
  misc_feature 4, 11, 59, 60, 411: n = A,T,C or G
aaangaatccngaagaataatgggttgtttccttttaatgttgtgatgttgctgaggtnngatggaccaagagccaggacacagtctagaagctttgaggtttcttttttcattgtttcttgaaattagaatttaagactgacattttgttgggggagttgaggagtgaagaaacacacatccccctctgttccctccattctgtgggacagtctgcatttattttattttattttcaatatttcatggttaaggatttgccattattttttaaaaacaaagttagctttgtccagtaagtaccatttcctctcagaagcagtgcctagtgtccttgccagtctgtgcctaggaatgtcttgggaattttgccaggactaacaaaactcagtccttgggttcctctctcangattaaccatttctctgactccagtaagagagaatgacacgggagaaaaaaaaaagaaatgtttcagaggccgac

SEQ ID NO: 25487 - DNA, 314 bp, Homo sapiens
  misc_feature 3, 8: n = A,T,C or G
atngcccnggaagaaatagaaaccctgaacagatcaattataaataatgcaattttatccataataaaaaattgtccaacaaaaaataagcccagaatcacatgaattcacagccacattttaccaagtgcacaaagaagagctggtatcaatcttactgaaactattacaaaaaaatcaaagaggagacattcctccctaactcattctataaaaccggaatcatgctgataccaaaagcagacacaactaaaaaacaagactgcacgccaatagccatgatgaacatagatgtagaaattctcaatactagc

SEQ ID NO: 25488 - DNA, 445 bp, Homo sapiens
  misc_feature 10, 11, 27, 52, 55, 56, 61, 403: n = A,T,C or G
taaatccccnngctgcttaattcagantgttcgaaacagaagaaagagaaanggnnttgangatgatggaggtgattcacctgttcaagatattgataccccagaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtttcactaggagacgtggaattgagactaataacttgaatgttaacactgtttactgttttttcacatgtagaaatggtctttgngtattttttctacagaggatttctctgattttattttctttg

SEQ ID NO: 25489 - DNA, 500 bp, Homo sapiens
  misc_feature 3, 20, 39, 42, 44, 47, 48, 56, 59, 60, 63, 446: n = A,T,C or G
gcnacttcccaacgtctgangtatcaataagctcctagnccngnccnnaagtgccnttnnaanaaggcctgctctaaattatctagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaggatcaatactataacattgatgtgcctagtagaacagcaagagcaattactactcgtctgggcagccttatccaaagtctggtacaactgtccttagactgatgagcaaaggaggagncaactaatgaagaaatgaataataaattttgacctgaaaaacattttattaata

SEQ ID NO: 25490 - DNA, 304 bp, Homo sapiens
  misc_feature 1, 3: n = A,T,C or G
ngntttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaattt

SEQ ID NO: 25491 - DNA, 369 bp, Homo sapiens
  misc_feature 9, 14, 34, 35, 120: n = A,T,C or G
cttcttccnattgntgggatgactgagccagtanngaccaattaaaaacgaaaacctgactaggttctgtagagccaattagacttgaaatacgtttgtgtttctagaatcacagctcangcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgggtgtgtgtgtgttttcagcaaattccagatttgtttccttttggcctcctgcaaagtctccagaagaaaatttg

SEQ ID NO: 25492 - DNA, 456 bp, Homo sapiens
  misc_feature 9, 15, 29, 52, 63: n = A,T,C or G
attccactnaaactnagctactgcaaatntagtctttctgtaaatgttattntaatatccagntgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgcacctggtgcttttaagtagggataaagtcatcctctcactgcaagcacagcatacctgtcctccaaaagtgacgttttagtgaacaggccgttttcaacacttgtgccttggggtgtcattgaagctttgtgaaaactactgatgtttctcagtctccttaaagttacgtccatgcttt

SEQ ID NO: 25493 - DNA, 466 bp, Homo sapiens
  misc_feature 2: n = A,T,C or G
anaatccccttttattactgtttattacttccatgaattttaaaatctgagggaaatgttttgtaaacatttatttttttaaagaaaagatgaaaggcaggcctatttcatcacaagaacacacacatatacacgaatagacatcaaactcaatgctttatttgtaaatttagtgtttttttatttctactgcaaatgatgtgcaaaaccttttactggttgcatggaaatcagccaagttttataatccttaaatcttaatgtcctcaaagcttggattaaatacatatggatgttactctcttgcaccaaattatcttgatcattcaaatttgtctggttaaaaaataggtggtagatattgaaggccaaagaatatcgcaaaatcatgaagcttcatgcacttaaagaagtattttagaataagaatttgcatacttacctagtggaacttttctagaattat

SEQ ID NO: 25494 - DNA, 374 bp, Homo sapiens
  misc_feature 2, 5, 54, 373: n = A,T,C or G
cnccncagtttgcgaactgagctttggaacaaagcccataaacagaaccaaacncttaggtgaatttagtataaaataaggcagcctttcaaatctgtagggaaagagtgggttattcaaaaaatgatgttgagacaactggccacccttggaaaaacagttaagttcatttttaatctcacacctttcatccaaacaaattccagatgaaggaaaacttttaatgggacatgaagctgtaaaaatctagagggaacaaaaaaatgtatataatcttccaggtgggaaggatgtgttaaacatgaaggagcataccatgaaagaaaaattgaatgttgagtgcatatttttaaatctcttgttaaccctcctnc

SEQ ID NO: 25495 - DNA, 455 bp, Homo sapiens
  misc_feature 48: n = A,T,C or G
gcaacaactgtacatatacacaaacacatacccagaaataagggaagncaaatgtgactagagcctagaaattgcttaaacgagatgaaaagtaaatgttctgtgggaatactgttattggaacttttcttaggtttgaaatttttcaaagaatttatagttctcctagcctatataagaaattatgtgaatatgtgtttgtgtacgcacacatgcatttttgagaacatttagggtatttactaatatcctatttcccaaggaatctcctcagcatatgtacattttattaagtagttctgctctgcataaatatcctaaactaaaatgttctgtcttctctataaaattataccatttataaggttcttgaaatgttttcctaaaatggcctaacaaaccttgtaccaaatctttatcttgtgcaaaacgaacgtctttatgaatttttaaca

SEQ ID NO: 25496 - DNA, 461 bp, Homo sapiens
  misc_feature 3, 16, 30, 32, 46: n = A,T,C or G
cancgcaggggcttcngctgagtggtggcntncttcccttacgganttacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacaagccatccaccttcagatgtgtctacgtgcgctctgccattcaactcggaaactataaagtaattctcaag

SEQ ID NO: 25497 - DNA, 475 bp, Homo sapiens
  misc_feature 2, 17, 35, 64, 384, 406, 466, 472: n = A,T,C or G
gngaaacaagcccaatnagcctagtaggtacattntctcaggcaggaaactttataggccaggntagagtaggatgatatgttcaaaatgttgatggaaaaaaaaaattgctaacaatgaatagtgtagccggcaaaaccgttctttagaagtgaaggagagaatgatactttcccagataaagctgagaaagtttatcaccaccacacctgtttttacaagaaaggctagtggagtcttcaagtggaaagaaatggaaggttaataataacatggaaacgtacgaaagtataaaacttacatagtcaaatttggaatctccaatctgtaatggtgtatgtaaatcatttacatctttagtttgaaggttaaaagatgaagctnttaaaatggatttaacaacttntaaagtttttccaaaacaaaaagacttaaattgtgccatcaaaaactaaaatatgggggngatggnggg

SEQ ID NO: 25498 - DNA, 429 bp, Homo sapiens
  misc_feature 5, 314, 394: n = A,T,C or G
gtganctacattgtcaaagaggctatagaaagcgcaattggtggtaattcttatcaacacagcaaagtgaaccagtggaccacaaatgtagtagaacaaactttaagccaactcaccaagctgggaaaaccatttaaatacatcgtgacctatgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggnctttctcctttgctctagttcatcctctaaccaccagccatgaattcaagtgaactcttttctcattctctttgttttgnggcactttcacaatgtagaaaaaaaaaccaaatga

SEQ ID NO: 25499 - DNA, 302 bp, Homo sapiens
  misc_feature 9, 15: n = A,T,C or G
cccaatctnaaagtnatattggaaaacatggaaatattaaaattttacacttttactagctaaaacataatcacaaagctttatcgtgttgtataaaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgt

SEQ ID NO: 25500 - DNA, 428 bp, Homo sapiens
  misc_feature 4, 17, 28, 41, 84, 87, 93, 95, 98, 99, 117, 118, 123, 165,181, 320, 401: n = A,T,C or G
aacnatccaggagtacntgagaccttgnggatcaacagaanttgactgacatccttttctgtccttccccttcctggtccttcngcncatgtnancgnnacagacacctttgtatgnnccttngtatgttcctatcaggctgatttttggagaaatgaatgttgnctggagcagagggganaccatctagggcgactcctgtgtgactgaagtcccagcccttccattcagcctgtgccatcccttggcccaaggctaggatcaaaagtggctgcagcagaattagctgcctagcgcctagcaaggtgcctttgtacctnaagcgtttaagtgtgaaatgttcaagtgaaccaaagtctgatccttgttacatgttggttttatggatttctatctattgnggctttaccaaaaaataaaatgtccta

SEQ ID NO: 25501 - DNA, 286 bp, Homo sapiens
  misc_feature 4, 6, 28: n = A,T,C or G
ctgntnttagactttcttatcacttatngttagtaatgtacacctactctatcagagaaaaacaggaaaggctcgaaatacaagccattctaaggaaattagggagtcaggttgaaattctattctgatcttattctgtggtgcttttgcagcccagacaaatgtggttacacactttttaagaaatacaattctacattgcaagcttatgaaggttccaatcagatctttattggtattcaatttggatctttcagggatttttttttttaaattattatgggac

SEQ ID NO: 25502 - DNA, 354 bp, Homo sapiens
  misc_feature 2, 6, 27, 40, 61: n = A,T,C or G
ancacnaggcctgccttacaagagctnctgaaggaagctnttaacatggaaaggaacaacncggtaccagccactgcaaaaacataccaaattataaagaccatcgacactgtgaagaaactgcatcacctaacaggcaaaataaccagctggcatcataatgacaggatcaaattcacacataacaatattaaccttaaatgtaaatgggctaaatgccccaattaaaagacacagactggcaaattggataaagagtcaagacccatcagtgtgctgtattcaggagatccatctcatgtgcaaagacacacctaagctcaaaataaagggatggagaaatatttaccaagc

SEQ ID NO: 25503 - DNA, 330 bp, Homo sapiens
  misc_feature 2, 11, 60: n = A,T,C or G
gncaagacaancgtgtccttcataatgaagttaaagtgagtatactgtggagaggacttncaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagc

SEQ ID NO: 25504 - DNA, 378 bp, Homo sapiens
  misc_feature 10, 351: n = A,T,C or G
gaaagaatcnaactcctgcggctctttggcctgaaagttgggaatggttgggggagataagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgacccaaatgtgtagtgtggtctggcaggcagacctttaggttttgctgcttagtcctgaggaagtgccactcttgtggcaggtgtagtatctggggcgaagtgttgggggtaaaagcccaccctacagaaagtgnaacagcccggagcctgatgtgaaagga

SEQ ID NO: 25505 - DNA, 304 bp, Homo sapiens
  misc_feature 10, 23, 27, 28, 39, 41, 50: n = A,T,C or G
gtctatttgncacagagatagcnatgnnttgatacctantnaaacggttncccctttgaagggttgaatattgttcacatagcaccccagcctgtggtgtatatgtttaatctgtcaaatctcattaaatttttcttctataagaatgctaatgataccaatttctagaattgaatgatttctactctgcctgttggactgcaaatttgaaatcccctatgataattagacccctccttagagtatattataatgaccatcgaacctgtatctaaaaattctagtaacttaaccatccagtctt

SEQ ID NO: 25506 - DNA, 414 bp, Homo sapiens
  misc_feature 361, 396: n = A,T,C or G
ctattttccccggcgcctcggaggcgttcaagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgctgctactgagtaaggggcattcctgttacagaccaaggagaactggagaaagaaagagaaaatcagttcgtggttgcattgtggatgcaaatctgancgttctcaacttggttattgtaaaaaaaggagaanaaggatattcctggactg

SEQ ID NO: 25507 - DNA, 414 bp, Homo sapiens
  misc_feature 13, 18, 59, 61: n = A,T,C or G
atacattatccgnacttnttaaaagaaacattggaccctggtgatcctgagacaaacantncaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataacccgatcctgcaaagctaattac

SEQ ID NO: 25508 - DNA, 202 bp, Homo sapiens
  misc_feature 197: n = A,T,C or G
tggccattcacagcccagcagaggctggaacctgcagaaacagctctcaattgtcagaagaggatttggttaggtttaaggaaaatgtgctacaacatattaatggataatttggagagtatttgaacttttattcttagagaatattttaaattaaaattttttattattagaactatattgcagaaaactttatnaaaga

SEQ ID NO: 25509 - DNA, 275 bp, Homo sapiens
  misc_feature 3, 4, 30, 52: n = A,T,C or G
ganngagaaagcccgacacatgctgccctnccgcgaagacctgtaaatgttncggacttaccctttaaattattcagaaggatgtcccgtggaaaatgtggccctgaggatgccgtctcctgcagtggacagcggcggggagaggctgcctgctgtctaacggttgattctcatttgtcccttaaacagctgcatttcttggttgttcttaaacagacttgtatattttgatcagttctttgtaataaaattgaccattgtaggtaatcaggagg

SEQ ID NO: 25510 - DNA, 361 bp, Homo sapiens
  misc_feature 2, 5: n = A,T,C or G
anagntcagatgaaagttgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtgg

SEQ ID NO: 25511 - DNA, 341 bp, Homo sapiens
  misc_feature 9, 45: n = A,T,C or G
agatcgagngacgaactagatacaatttgtcccaaagctcccaanttagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagagg

SEQ ID NO: 25512 - DNA, 355 bp, Homo sapiens
tctccggaacacaaagggagcacacagctcttcttaaaattgaaggtttttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttacta

SEQ ID NO: 25513 - DNA, 403 bp, Homo sapiens
  misc_feature 46: n = A,T,C or G
gatgaaccaacccttatctggcaacataattgcagcacaataatgntttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagc

SEQ ID NO: 25514 - DNA, 454 bp, Homo sapiens
  misc_feature 11, 15, 28, 30, 44, 70, 106, 425, 446: n = A,T,C or G
agagaatatanggancgagcggatggtnanaaggacacctactnttcttggcttaacccttctggaaggntctgactgtgtagacccgcagcaaatagttcatgtnggaaagaatgaaaacaactcaagttcatagcagccagcctgccgcattggacctcccttttaaaaactgagaccaagactcccatcagctggtctcggatttacatcggaactgctcaggattgatacatttcaagtctgtaaatacggcaccaacgccatttaccctaatttaagaacagcggggactgaccctccgtgccgagggctgcatgctacccgcactaagtcaatacatggctcccgattcgcagctgcgtcttgcagcacttgtcacgttggcagcactttgagagcaagtctgagtgggcccacatgtnacctgctatgaaaaccatttnatagtgtg

SEQ ID NO: 25515 - DNA, 386 bp, Homo sapiens
  misc_feature 47: n = A,T,C or G
caggatggttggatctccttgaagtgcttccctctctgtcactcttncttttcttcatttctcactcagtggtgagagatcttgatgccaactggaaccacctgtacctcagtgacccacctgagcaccaaaaaatcacacaggttcttctgccatgagtgaaagagcaatgagcttacagagctaagtcccacttagcttttcaaatatctttatgtactctgaagagcctatatttgagttctgaagccaggatttcttgtcttgatccatgaaatctaacctgctgcactagatttacctaaaaggtattccaaaaagattttacgaataatagcaacatttataaaagaagaaatgcaagtagccaacaagccaacaaacac

SEQ ID NO: 25516 - DNA, 297 bp, Homo sapiens
  misc_feature 10, 16, 30, 60, 68, 102, 123, 249, 269: n = A,T,C or G
tgagggcctngcgccnaagctggacccggnggagatgaaacggaagatgcgcgaggatgngatctctnccatacggaactttctcatctacgtggccctccngcgagtcactccatttatctnaaagaaattggcagcatatgaagacaggacatcacatatgaatgcacgatatgaagagcctggttacagtttcgactcctctctgcaagtgaataggcccagaaaggtgtaagagactctttgaanggacataaaactctgcttgntaagaacaagtttggctctggtaactga

SEQ ID NO: 25517 - DNA, 337 bp, Homo sapiens
  misc_feature 2, 6, 336: n = A,T,C or G
cnatanaaaatctaaagtagaaaaataaataattggctgggttcgtgcagtggctcacgcctgtaatcccagcactttcagaggctgaggcaggaggattgcttgacctcgggagttcaagaccagcctgggcaacatggtgagaccccatctctgggaaaagatgaaaaaaaaaattagccaggcatggtggcttccacctgtagtcccagctgctctggaggctgaggtgggaggatcacttgagcacaggagattgaggctacagtgagccctggtcacactattgcactccaacctgggcagcagagccagaccctatcttagaaaaacaanc

SEQ ID NO: 25518 - DNA, 430 bp, Homo sapiens
  misc_feature 4, 14, 29, 46, 47, 48: n = A,T,C or G
aaantcttaggaangttggaaggaagaanggaaatattgggatccnnntttaaaaattatatcaagattttgcagggcctttctgtgcaccacctccttttctagtttaattgtaacacaaatccaattctgtgatagtgaaacaaatcagatactaaagttaagaatgaaaaaaaaaattgtaaaaagttggataggaatgaattttacttcttttaaaatacttatatacttttattgcaaccatttatgttattttaattttcaaagcaatatattttaatttttattttaattttttaaaatttattttaatttaaaatttattttaatttttaaagcaatatattttaaatgcagcttatagtgtccagttgatccttgaaactgcttcttgtatttatttttcaaatcccatactaagattctg

SEQ ID NO: 25519 - DNA, 336 bp, Homo sapiens
  misc_feature 46, 48: n = A,T,C or G
aacccctttgctcatcactcatttccaaaatttatattttcaaagntnattttgtacagagttcctaaaaaaagggatcatgatgccagtgtattgcctcactgattgctaaatgaagaggactatactgaagcattcaaagaacgtgatgtgcctctggggcgactgaaggattgctatctgacttatgcatttaaaaccttcaaagtggaagtttgtctggaatggcttaggcaaacagactgggttggattgagaattgaatgtatacataaaatttggtttggtcagatgagaacaccaaatgtggtagctagctcacctttatttatgaga

SEQ ID NO: 25520 - DNA, 123 bp, Homo sapiens
gagctgctagggtcattacagctttttacttttgtcatattttgcaaaacatttgcctcttgctattaatatttgctttgtaaaaattactgacatttaataaacatttgtaaacaattcaga

SEQ ID NO: 25521 - DNA, 127 bp, Homo sapiens
  misc_feature 3, 39: n = A,T,C or G
ttnctaagatattgcttagccgttaagtttttaacgtanttttaatagcttaagattttaagagaaaatatgaagacttagaagagtagcatgaggaaggaaaagataaaaggtttctaaaacatga

SEQ ID NO: 25522 - DNA, 349 bp, Homo sapiens
  misc_feature 3, 6, 59: n = A,T,C or G
tantgnacccgacaacctttgcaaaagaggaaacagagtttttatcaatccattctcanttgaccaatttggaagacattgatgtcaatcataaaagcaagttatcttctctgcaagatcttgaaaaaactaaacaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgc

SEQ ID NO: 25523 - DNA, 403 bp, Homo sapiens
aaaacaacccaatcactcactgaaattatgctttgtaaaatatatatttttaaattttcggactcggccgtgtatattcaggaaatgtaaattatctattaagacccacaatcatttgtgagatgtttatattgttctctgataggtatagatgacattaatttcaatagatgttcattcatgcattcattcatttattttttgttcagaaaatgtttatcactgtgtactggacactgagaaaatgacagtggcaaaatagacaaagtctctgcccccatggagattaaattccattgcatgctggtgtctggtcataggatctgaatgtctagttagaaaggaggcagatatgaccagaattatttcagaacgatatagtacctcctacacctttcacctg

SEQ ID NO: 25524 - DNA, 336 bp, Homo sapiens
  misc_feature 4, 13, 55: n = A,T,C or G
aaanccccaaaantcggtgaatccaagagctggttttttgaaaagattaacaaanttgataaactgctagccagactaataaagaagaaaagagagaagaatcaaatagacacaataaaaaatgataaaggggatataacccccaatctcacagaaatacaaactaccatcagggaatactataaacacctctacgcaaataaactagaaaatctagaagaaatggataaattcctggacaaatacaacctcccaagactaaaccaggaagaagttgaatctcttaatagaccaataacaaattctgaaattgaagcagtaattaatagcctacca

SEQ ID NO: 25525 - DNA, 395 bp, Homo sapiens
  misc_feature 3, 4, 51, 338: n = A,T,C or G
ccnnttagcatcttttttaaacaaagtcatattgctcttctgtgcttaatntatatgtatagagaaataaaagctggtaacataattagttttttctacctttataataaatgtgtttttggctgggcgtggtagctcacgcctctaatcccagcaggttgggaggtggaggttggtggatcacctaaggtcaggagtttgagaccagtctgacccatatggtgaaaccccgtctctactaaaaatacaaaaattagccaggcatggtggtgcacacctgtagtcccagctactcaggaggctgagacaggagaattgcttgaactcgggaggcagangttgcagtgagctgagattgtgccacttgcctccagcctgggtgacaagaagtgaga

SEQ ID NO: 25526 - DNA, 403 bp, Homo sapiens
  misc_feature 2, 8: n = A,T,C or G
gngaattncccagccagcgcaggggcttctgctgagggggcaggcggagcttgaggatccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagt

SEQ ID NO: 25527 - DNA, 424 bp, Homo sapiens
  misc_feature 1, 3, 59, 397, 418: n = A,T,C or G
ngnaaggaaccgataaaaggtttctaaaacatgacggaggttgagatgaagcttcttcntggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatctaaagcctagttaacgcatttactaaacgcagacgaaaatggaaagattaattgggagtggtaggatgaaacaatttggagaagatagaaagtttgaagtggnaaactggaagacagaagtccnggaagg

SEQ ID NO: 25528 - DNA, 466 bp, Homo sapiens
  misc_feature 1, 2: n = A,T,C or G
nnattgcccagccagcgcaggggcttctgctgagggggcaggcggagcttgaggatccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaagtg

SEQ ID NO: 25529 - DNA, 144 bp, Homo sapiens
  misc_feature 48: n = A,T,C or G
gacagtttggaatggctcaaaagaaaatgtgcagcttgcgtgaccacntcaaaagattgtcccacctaggcagctgaagaacaacaacttagccttggcaacaaagcaagatcccgtccttacaaaacaaacaaacaaacatcc

SEQ ID NO: 25530 - DNA, 450 bp, Homo sapiens
  misc_feature 26, 35, 49, 79, 232, 344: n = A,T,C or G
gacatgcacataatatagatacacanggaataatntctgatccaggatngtccttccaaatggctgtatttataaaggnttttggagctgcactgaagcatcttattttatagtatatcaaccttttgtttttaaattgacctgccaaggtagctgaagaccttttagacagttccatctttttttttaaattttttctgcctatttaaagacaaattatgggacgtttgtngaacctgagtattcttctttttaccagttttttagtttgagctcttaggtttattggagctagcaataattggtctggcaagtttggccagactgcttcaaaaaattaatgngtatccagggacattttaaaaacctgtcacagtgtttattgtggtaggaagcaattcccaatgtcctataagaaatgtgcatcaagccagcctgccaacatggtga

SEQ ID NO: 25531 - DNA, 126 bp, Homo sapiens
  misc_feature 44: n = A,T,C or G
aacaggacagagaacaaaaacagctgttagcttgagacacccanagacaagaatctgacaaaaatggggaaagtgcaagtcctgaaagagatagggagagtttgaaggtagaaattgagacatctg

SEQ ID NO: 25532 - DNA, 382 bp, Homo sapiens
  misc_feature 4, 11, 44, 51, 55: n = A,T,C or G
ctgngcggggncttgtgctgagggggcaggctggagcttgaggnttccgcngatnagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagctta

SEQ ID NO: 25533 - DNA, 383 bp, Homo sapiens
  misc_feature 8, 20, 41, 299, 306, 343, 366, 369: n = A,T,C or G
ctgaactntatcaacatctnaaagaggaaaatgggatggtnacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgcatttttgtctaattataaaattggcacataattcaaaaatatacatttgagatgatttgtcctcccaaattatacaagttattttatggnataaagnggtctctctggaaatgtttttaaaaaaaaattcttangctctctttgcgaaataaaactnttnaaatatttgaaatg

SEQ ID NO: 25534 - DNA, 456 bp, Homo sapiens
  misc_feature 4, 18, 32, 49, 109, 118, 163, 192, 309, 345, 436: n = A,T,C or G
ccantgacagaaatggantcgaaataccagtntgtgaagctgaatgatnttcacttcatgcctgtcctgggatttggcacctatgcgcctgcagaggttcctaaaagtnaagctctanaggccgtcaaattggcaatagaagccgggttccaccatattgatnctgcacatgtttacaataatgaggagcangttggactggccatccgaagcaagattgcagatggcagtgtgaagagagaagacatattctacacttcaaagctttgggagcaattcccatcgaccagagttggtccgaccagcctnggaaaggtcactgaaaaatcttcaattggctatgtngacctctatcttattcattttccagtgctgtaaagccaggtgaggaagtgatcccaaaagatgaaaatggaaaaatactatttgacacagnggatctctggccacatggga

SEQ ID NO: 25535 - DNA, 294 bp, Homo sapiens
  misc_feature 2, 53: n = A,T,C or G
tnccgcagccagcgcaggggcttctgctgagggggcaggcggagcttgaggtnaccgcagataagtttttttctctttggaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtattt

SEQ ID NO: 25536 - DNA, 429 bp, Homo sapiens
  misc_feature 9, 10, 27, 44, 406: n = A,T,C or G
tgtgaatanncatggaggccgcgacgngtgacttcgaaattgtnttccctgctgttccgcaggacctccaccttcgccctcaccatcatcgtgggcgtcatgttcttcgagcgcgccttcgatcaaggcgcggacgctatctacgaccacgtcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgttgaagtatgtttaagtcaagcatgctcangaaataaatgtgaattgcccttg

SEQ ID NO: 25537 - DNA, 264 bp, Homo sapiens
ggggtcaaggaggaaaagctgttgaaaatctttctcctatttatttagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 25538 - DNA, 242 bp, Homo sapiens
  misc_feature 6, 34: n = A,T,C or G
attttnagtaaagataaattatattgtttttttntatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgcc

SEQ ID NO: 25539 - DNA, 463 bp, Homo sapiens
  misc_feature 3, 310, 321, 363, 399, 410, 414: n = A,T,C or G
gangctaaccaacacaatcggatcgactgttctactaaacaacaggaaaatgtgtatctggcagcctgtggagaaacactaaacattgatttttctttgccttttacggactttgttccagctacatgtaataccaagttctctttaagagtatgtatagttgaatgcattatttattccacaggtgtattagtaaatttgatttcccaaagcttatcttcactctcttctccccagtccattgcaacttcaaagtatttttagctttcctccaatgtctactacctttagtgcacagagttcctgttgntttctttttgnagttaactgcatctaagaaattggcaattaaaaatatctcanggtgattattttcttagagtcatttctgatctctgnggctaatctgnatgntagcccttctagccctaatggttactaatcatatgaactaattttatac

SEQ ID NO: 25540 - DNA, 169 bp, Homo sapiens
atgcaaacccatgaagctgttgccctacctcacaccatatatacaaattaattcaaattggatcatttgcctaaatataaacaatacaactataaaactattagaagaaaacatagcagtaaatctttgtgattttgtattaggcattgattttttagacattcaccat

SEQ ID NO: 25541 - DNA, 463 bp, Homo sapiens
  misc_feature 9, 15, 409, 430: n = A,T,C or G
gctcccggntcggangaggccaaggtgcaacttccttcgatcgtcccgaatcttggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgctctgcctgatcatcaaagccctcaaggaaccaccaagagacagaaaggaacagaaaaacattaaacacagtgggaatatcacttttgatgagattgncaacattgctcgacagatgcngcaccgatccttagccagagaactctttggaac

SEQ ID NO: 25542 - DNA, 355 bp, Homo sapiens
  misc_feature 3, 33, 58, 244, 355: n = A,T,C or G
gancaaggcccgtctatttgcagcagagatatnttgaaaagaagaaaattgttttatnttaaaaggaaagccatgaccacctttctacctcagatccatcttcatccattgcattggaaactgctttgtgctgctgcagtctgcaaagtctagagcttttatcaggccatgtcatacccaagaaagcacctatttaaagaaaaaacaattccctgagctctcaactccaagttgtagatttggngcttccttgtcttactttaaaaagtcatgtgttaattttttttctgcctgtatttgtatgcaaaatgtctctatctgctattaaagaaaagctacgtaaaacactcattgn

SEQ ID NO: 25543 - DNA, 248 bp, Homo sapiens
  misc_feature 4, 48: n = A,T,C or G
gaanaagagtgcaatcaaagttaagtcattatgaggtcaacgttgtanattttatttatatttacctgcttgttttacaaaatggagccatacttcctatgctgtttgctaccttgccttcttttttaaaaaatgtaacagcatatggtgacattagtatataatcatcagtgtcatttataataattgccatatattttgctgtgtggatttttgatagttattaaacaaaacccctattgatgggt

SEQ ID NO: 25544 - DNA, 386 bp, Homo sapiens
  misc_feature 56, 57: n = A,T,C or G
taaaatccccgatgaaaccaaaagtgagcctgaatagccaaggcaatcctaagcannaagaacaaactggaggcatcatgctacctgactgcaaactatactacagggctacagtaaccaaaacagcaaggtattggtataagaacatacacagagaccaatgccacagaatagagaactcagaaataagaccgcatacctacaaccatctgatctttgacaagtctgacagaaacaagtaatggagaaaggattccctattcaataaatggtgctggggtagctggctagccatatgcagaagattgaaactggactccttccttacaccttatacgaaaattgtctcaagatggattaaaaaccatctttaaatgtaaaacccc

SEQ ID NO: 25545 - DNA, 359 bp, Homo sapiens
  misc_feature 2, 4, 306, 321, 347: n = A,T,C or G
ananagagagacagagagagagagatggatatctatctttccctctatgtgggcctctcttagggttctgccttcgttttccacataaacatacttttactgtagttcattctatttccatttctttcaatactatttatattgttgggaaaagaatgattcccaaattagtcatcgtattaaaactcatctctgacatccagataccagtatggaactattaactttatagctgagattggatgctttctatttatgttcaaaactaaatggctgaatctttcactcccattttcatcctactgnttttctcacgcagtnaggtattgccacatctgttcaggtgnggacattcttga

SEQ ID NO: 25546 - DNA, 419 bp, Homo sapiens
  misc_feature 9, 57, 334: n = A,T,C or G
taacatccncacctgtaagaccaaagtgaagacatgaattaagagattactcaaganaaattgattttagtagataaacaaggttttttgaaacaatttgctcccttttgatcacaagagcaggatttttggcctaaagcatctagaaaactgcagtcttccttttcagtgcatatccatggagtagtctacaaccattcaccaatgtgccaggcatagggaattcaagagcaacaaggtgaagaaaatcttaatcagctgattgagaatccattttatggaaagatccacctctttggggaaatggacttgatatttagaaactaaaacaatnttaaaattttcaacaatagaaggacagaaataggatatgaattaaacaccaagcctgtggtaatttgctttcagtgaaaaagatg

SEQ ID NO: 25547 - DNA, 472 bp, Homo sapiens
  misc_feature 1, 402, 465: n = A,T,C or G
ngaaattcccattaataaaagttgattaaaaataaatacaataaaaaattgtatattttatatactgtaaaatcttatctcatattaatataaattaaataaaaagcattctcacaagacagagaaatatttcatactgataaaaggttcaattcaccaggaatatgtaattgttctacaactctaattcacttactaacatagctttaaaattatataagataaaaatgtctgaaccacaaaagacaaaaacacaaattcataatgtagcaaggttttaacacatggtgctcataaatgagaagaaaaaagatatttaaattcagtaaagatataggagttttggaaacagaatgaactattttgaattaaatgacatatgtagatggtttatactcctangggaggcagacgctttttagcccactcaggaatttaccaaaaaatgggcctgtcttgggcccnagtgagt

SEQ ID NO: 25548 - DNA, 100 bp, Homo sapiens
  misc_feature 3, 25, 27, 35, 49, 82: n = A,T,C or G
ctngactggatgtgtctagtgctgntnttgatcangcaacttcctctgnatacgcgaagcatgtgtcaatcatgggactggntttgacggaccccgcctg

SEQ ID NO: 25549 - DNA, 384 bp, Homo sapiens
  misc_feature 4, 17, 28, 336, 346, 380, 383: n = A,T,C or G
tccntatgtagagatgntccttaccctnttgaaatttcttagccagcattttgttctgcaggggcccactgaagcagaaggtttttctctgggggaacctgtctcagtgttgactgcattgttgtagtcttcccaaagtttgtcctatttttaaattcattatttttgtgacagtaattttggtacttggaagagttcagatgcccatcttctgcagttaccaaggaagagagattgtctgaagttaccctctgaaaaatattttgctctctgacttgatttctataaatgctttaaaaacaagtggagcccctctttatttcatttgggtattgngattgctggncaggaaaaatgctgatagaaggagtggaatctgntgnc

SEQ ID NO: 25550 - DNA, 143 bp, Homo sapiens
ccaggcgtggtggtacatgcctgtagttccagcttctcaggaggtggagacaggagaattgcttgaggctgggaggcggaggttgcagtgagccgagatcgtgccgctgcgctctaatctgggcgacaaagcgagactccatg

SEQ ID NO: 25551 - DNA, 254 bp, Homo sapiens
  misc_feature 1, 13, 59, 60: n = A,T,C or G
naaacagccggtnggcagctgacgggacaagccggggtctattttgttgcgggtttttnncaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaac

SEQ ID NO: 25552 - DNA, 413 bp, Homo sapiens
  misc_feature 2, 399: n = A,T,C or G
anaataaccctttttaatcatttagagtttttttattctctccttcgaaaaatgcacttatgccaaccttttgaatacagtttcaagagtctgaataccttctacatccatccatgggcatagactccaagctgagaacctctgtggtcagaatttcttctcactactgtgttataaagtgcaatttggtgtaagcttaggggaggaagagggagaagacactggactttctattgttagacttgtattttattccaatcctttcatagatttgctctttgattggagataaagtgtaaaacctctctatatcatattctatatctatatgatattctatatcataatttcttggatggcaaaatgtggattaaaattctgtcctttctttcctcaaangaatggtgaaattt

SEQ ID NO: 25553 - DNA, 413 bp, Homo sapiens
  misc_feature 1, 57, 302, 306, 334, 343, 381, 397, 410: n = A,T,C or G
naaaaaaccccacaggttaggagacgtcgctttgaacgtgctataggaccttctcantcacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgcggctatgattactatgccttttctaaagatcaatactatacattgatgtgcctagtagaacagcaagagccattctactcgtctgggcagccntatncaaagctggtccactgtccctagactgntgagccaangaggggccacttatggagaaatggattattaattttgncctggaaaacattttnttattaaagaatnttg

SEQ ID NO: 25554 - DNA, 350 bp, Homo sapiens
  misc_feature 6, 300, 345, 347: n = A,T,C or G
gacaangatccaataatgtctggtcgcggcaaaggcggaaaaggcttggggaagggtgtttgctaagcgccatcgtaaggtgctccgggataacatccagggcattacaaaaccggctattcgccgtttggctcggcgcggtggccgtcaagcgcatttccggtcttatctatgaggagactcgaggtgtgcttaaggttttcttagagaacgttattcgagacgccgtcacctatacggagcacgccaagcgcaaaactgtcacagccatggatgtaagtatatgccctaaaacgtcangggcgcactctgtatggcttcggcggctgaatctaaaaatacgcngnctc

SEQ ID NO: 25555 - DNA, 414 bp, Homo sapiens
  misc_feature 47, 316, 382, 411: n = A,T,C or G
ggttccaacttttctgcttatctgggaggtgttgggcgcggacagtngagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgcctgcttaatacattctanggcagagaacccaggatgggacactaaaaaaatgtggttatttcattatctgcctggattatttgngttttgtacacaaaaaaataaatgtttgnttt

SEQ ID NO: 25556 - DNA, 378 bp, Homo sapiens
  misc_feature 2, 21: n = A,T,C or G
cncgaaagatgacatcacctnttggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaaagcattttg

SEQ ID NO: 25557 - DNA, 475 bp, Homo sapiens
  misc_feature 60, 360, 459: n = A,T,C or G
tctgacttcccattagcaacggtggaagccagaagatagtggaacatcttcatagttctnaaataaaatataaaatcttataaccaccaaaaatgtccatgagaaagagggaaaaactgtatctttgggcttgcaacccacagaaaagagacattatcaaagatgtacttcagggagaaagaagtaatcctttgattacttaaccaaagcaaagagtgtaagaattacatcagagtgtaagaatcaagtaaagcactcaaaatggcaaatgtgaaagtataatgaaacaagaaatgacggtatgcaacaataataaaaatttcttctggtagttaaaaaaatcggaactaaatatgtgcnactatgatatatcaataaaaaaacccaaaaatgcatgatgagaaaatcatgtaaatcaggagactacatgtatccaaatctagatttaatgaacaagcntgggtaagaattgttt

SEQ ID NO: 25558 - DNA, 358 bp, Homo sapiens
  misc_feature 2, 9: n = A,T,C or G
tnaaaaaanccctcagccatgcaaagcagcaagaaaataggacccacagtgaggagatttatcagccaacaatgaccaaccctgaactgacacagaaacagggacattaaaatagagataataccagtttgggaaaattacttaagctaaacttttacacagtttatattctttccttatatgtgttatgcttcaatacagttttattatttaaaaaaatcaaaactgtataaaaagctaagtagaaataggaagatattttaaaatacccaaatctatcttctaaagacagatactataatgtgtgatgtgaagatgcctactggataggattaatgcatattagatgttgcagaag

SEQ ID NO: 25559 - DNA, 328 bp, Homo sapiens
  misc_feature 1, 7, 60, 304: n = A,T,C or G
naaaaanccctcctggaccagatggattcgcagcccgaattctaccagaggtacaaggtnggaactggtaccgttccttctgaaactattccaatcaatagaaaaagagggaatcctccctaactcattgtatgaggccagcatcatcctgataccaaagccaggcagagacacaaccaaaaaagagaattttagaccaatatccttgatgaacatggatgcaaaaatctcaataaaatactggcaaactgaatcagcagccatcaaaaagcttatccccatgatcaagtgggcttcatcctangatgcaaggctggtcaatatacgc

SEQ ID NO: 25560 - DNA, 439 bp, Homo sapiens
  misc_feature 1, 8, 58, 299, 324, 350, 357, 370, 414: n = A,T,C or G
ngatgaancccatatgtttcatatgatctaaactgtattttccaatttaaattaaaantgtaatatagattcagaaaggttcatatttttctaatgacttcattctatattattttgttaggttgcataaagaagcaaggaattgtacttgtattaaaagatgaagaaagctattaggtatatttgtcatgactgcaaatgagtctatgcccgtttaaaagaaaagatggccactattttaaagtgagctttaatatgcctttatataaacaaatttgaagtcaggttaagttgggtgngttacctaacaagccccataagccncggggttggcctatttggataatccnagcccgngacttaatgtgangccttgcttggcttttggctggcctaacctcattggcatgtacncagaacattttaaaccttttttttc

SEQ ID NO: 25561 - DNA, 341 bp, Homo sapiens
  misc_feature 13, 57, 298: n = A,T,C or G
gacaagaacctgntggagctggcaaggtcaccaagtctgcccagaaagctcagaagnctgaatgaatattatccctaatacctgccaccccactcttaatcagtggtggaagaacggtctcagaactgtttgtttcaattggccatttaagtttaagtagtaaaagactggttaatgataacaatgcatcgtaaaaccttcagaaggaaaggagaatgttttgtggccactttgggtttcttttttgcgtgtggcagttttaaggtattagtttttaaaatcagtactttttaatggnaacaacttgccaaaaatttgtcacagaattttgagacccattt

SEQ ID NO: 25562 - DNA, 394 bp, Homo sapiens
atctaagatctttattctctaacgttcttggtcctattgaaacattgcagtatgcaaaactactgcaatgttaaacccaagagaaaagccattatcatgtgtatgctggtcatcatgatcagtgtggtacaatttttaaaaataaactatcatgcccttcatgccattatttgtctttatttctatgatttataatcctgatatgtgatgtgtttgtaacacagggtgtgcacttgagcctggttttactgtttttattagacagagttgtttatatgctgtaactgtaacgcagcgagactggttctacagccatgtgtcgtaatcttgttccccgtccaagctgttgtatctgaaggtacccagtttgcacccaggatgagggaacgcattc

SEQ ID NO: 25563 - DNA, 500 bp, Homo sapiens
  misc_feature 4, 18: n = A,T,C or G
cacncggggattcggccnttatggcggggaggggaaaaagaggcaaacccatcagcatagttgatgattttaagaccagtctttcctaactggtatgaaaactaggcaaaatgttaaggatatagatgatttgatcaacactatcaaaggtcttgccttaattgtcatttataaagcatcagactcaataacagcaaaatatacattattttcaaatgcacatggaatgttcatcaaaatagtccatagtaaggctcaagaattttcaaatgattaaaattacacagattatgttctttgatcacaaggaaattaaattagaagtcggtaacaataaaatagccgaatagcctcggatgtttggaaattagaaaacactctttcatactatcaaagagtcaaggaataactcagttgaaattatgaaatattttaactgaatggtaatgaaaatacaacatacccaaattcgtgaatgcagctgaagctgtgctaagggg

SEQ ID NO: 25564 - DNA, 434 bp, Homo sapiens
  misc_feature 11, 13: n = A,T,C or G
taagtcggccntntatggtccgggaagagaactacagttatgtcagctacccagaacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacttgcacaatagtattgtttttattactggtttaatggagtaatggtacttttattctttcttgatagaaacctgcttacatttaaccaagcttctattatgcctttttctaacacaga

SEQ ID NO: 25565 - DNA, 104 bp, Homo sapiens
  misc_feature 7, 85: n = A,T,C or G
atggcgngggtgatttttgacgttcatacctaatctagactttatgaggaatttttttttttaccctcgtaatttctctggaaangtaattttcttttcttttc

SEQ ID NO: 25566 - DNA, 466 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctcttttttctggaggctggcacctgattttgtatccccctgtagcagcattactgaaatacataggctta

SEQ ID NO: 25567 - DNA, 283 bp, Homo sapiens
gatatggagctgctgagcccataccattgctgcattcttggggggagctgctgttcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgt

SEQ ID NO: 25568 - DNA, 426 bp, Homo sapiens
  misc_feature 2, 26: n = A,T,C or G
tntattggaccggggggcaaccaagnataatgacaggccttggaacttctaggatgtgtcctacaggcaaatccaaacacgtcttctgggctgtgttttcatttaaaatcgattggatgaagttggcaccaaaagcacatttcattgtactcagtattttccctagttctggtctgtgcttgccatattgttgggttcagtatcactgtcaactgagagacaagggcacatgagcaggactgaaagtatttgttctgttccacctctgtacctggcagaaatgttagaactgccaaaggcctggcatgactgaagcctacgaaactaactgtgtgctgttgaggggcaggaaggaattaacaataggaagagattttatttcccttctgaaattttttgtttttccttgaaccttgacatttctga

SEQ ID NO: 25569 - DNA, 371 bp, Homo sapiens
aaacagggtctgctattcagttacaggagtcttttcgaatgtagtcagtatggtacctacaaaccatgatttgtgtgtattatggacaaaaattcatcataattctaatagaatgattttaaagccaagtcagcttggagtatttatacagcttgtatttacttttgctaaaataattgaatttgtaacaattataaggctgcccagatctctttagtgatgagtattgattattacactcagaagctttccctcattaaaaataaagtgttctagtcattgtggctccatcaacagaccttagtgtcattgttacagtaatcatgtgcttgatggatatattgggacctctttaaagcttcagttgtaac

SEQ ID NO: 25570 - DNA, 173 bp, Homo sapiens
  misc_feature 3, 6, 161: n = A,T,C or G
acnggnatcatataaagcaactgtcgacttcagcctgtttgtgagtttagttgtgcatgcctttgttgtatataagctaaattctagtgacccatgtgtcaaaaatcttacttctacatttttttgtatttattttctactgtgtaaatgtattcctttgnagaatcatggtc

SEQ ID NO: 25571 - DNA, 489 bp, Homo sapiens
  misc_feature 1, 14: n = A,T,C or G
nttggccggggaancctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtaggaggcgacaaacctaccgagcctggtgatagtttggttgtccaagatagaatcttagttcaactttaaatttgcccacagaaccctctaaatccccttgtaaatttaacttgttagtccaaagaggaacagctctttggacactaggaaaaaaccttgtaggagagagtaaaaaatttaacacccatagtaggcctaaaagcagccaccaattaagaaagcgttcaagctcaacacccactacctaaaaaat

SEQ ID NO: 25572 - DNA, 105 bp, Homo sapiens
  misc_feature 13, 24: n = A,T,C or G
aaacctgaagaanccagctaaacnaaaagacagagctctaattctaaagcgacaactcctaaacctcaaaagccaaccaaagcacccaaaaaaccccactttcta

SEQ ID NO: 25573 - DNA, 252 bp, Homo sapiens
  misc_feature 2, 24, 28, 36, 38, 44, 48, 50, 55, 101, 104, 143: n = A,T,C or G
anaggggggtgggggggcgaaaanaggnggggaagntngactcntccntnctcanggaactcaacattactagtcacaagcccctatacttccctctacantantttaccacaacacaatggggctcacttcacccatcacanttaacaacataaaaccctcattcacacgagaaaacaccctcatgttcatacacctatcccccattctcctcctatccctcaaccccgacatcattacccgggttttcct

SEQ ID NO: 25574 - DNA, 317 bp, Homo sapiens
  misc_feature 27, 284: n = A,T,C or G
tggcccggggaggcattgaggcagccnagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagtaaaaaatgtatttaaaaga

SEQ ID NO: 25575 - DNA, 331 bp, Homo sapiens
  misc_feature 2: n = A,T,C or G
ancgtaaggacttgtactatattaccataatcaactaccgtaatgtatgctataggccaagcgcggtggctcacatctgtaatctcagcactttgggaggccaaggcagggagatcacttgagctcaggagttcgagaccagcctgggcaacatggtgaaatcctgtctactgaaaatacaaaaagtagccaggcgtggtggtgtgtgcctgtggtcccagctcctttgggtactgaggtgggaaggatggcttgagcctgagaggtcaaggctgcattgagccatgatcatgccactgcactctagcctgggtgacaaagtgagactgtt

SEQ ID NO: 25576 - DNA, 424 bp, Homo sapiens
gcattttaaaatatcttacattttattttttgagaaataaagttggtgcagtcgctacccttgctggtatgacctacaatgtgctgcatttcagtttctaatttctgaatgtgaagatgacgagccttgttttttcctaatataatgacaacaaacacaaagctctacccaaaatatacattacattgtaaatatttcaagtttgtgccagttaaggacagttgtgaaggacaggtgatttttattctatttacttatttattttcaccattgtggaaacagtggaagggaataaaagcactcgcacccatccgctctgtttgctggctctctgatgacaaacggccgatatgtggagagcacatacctcatttacatcagatgcataatgtactctatctgggatattagcttctcggtcttg

SEQ ID NO: 25577 - DNA, 381 bp, Homo sapiens
  misc_feature 2, 3: n = A,T,C or G
cnnttggccgggagaaatcaacaggacagacgagtactcttctaagatgctgtggaggggtgggatggaaggattgacaggagccatgtttgggtttctcttcccttctcagtatatatttcctaatatcaatatttctcaggggctataaacattttcttctttgtccagctcaagatacagattgaacttcaaacaaggtagaccagagacaattttttatttgaatgaatagaatggtggactaaaataaaaggaaaaataatgtcttgattgtaactgttatcttagttgtgacaatacattgaggccatcttatctaacactgttggagtattataagggcaataagtttaatctcttccttataagtttggaagc

SEQ ID NO: 25578 - DNA, 279 bp, Homo sapiens
  misc_feature 13, 28, 63, 217, 237: n = A,T,C or G
ggaataagaagantcaagccaataaaantttaaaaaacagtttttacactgatatgaaaaagngatcattttgattggcaactcgtatctcagacaaaaatagtatctccaaaaaataagagctcctgcgaattgataagaaaaaagaccaataactttttaaaattaattttttggcttaagaggcattacagaatttacagaaaataagtatgtntagatataggataaaacagngttcggaggaatatccatatctttaaacatgactattacagg

SEQ ID NO: 25579 - DNA, 240 bp, Homo sapiens
  misc_feature 9, 18, 96, 119, 122, 129, 134, 139, 206: n = A,T,C or G
tttgaggcngcccagcgnggggcttctgctgagagggcaggcggagcttgaggaaaccgcagataagtttttttctctttgaaagatagagattantccacctccttaaaaaatatagncantaggttnctaanatatngcttagcgttaagtttttaacgtaattttaataccttaagattttaagagaaaatatgaagacttanaagagtaccttgaggaaggaaaagataaaaggtt

SEQ ID NO: 25580 - DNA, 388 bp, Homo sapiens
  misc_feature 1, 2, 25, 34, 54, 57, 65, 85, 92, 98, 179: n = A,T,C or G
nnggcgcggggtgcaggggaggagntagaaaaangattcatagcttgtaaaaanggnttgggganatttatgactacttattttngaaaatnccaagnatttcccagaacctagaattgttgagtaattttctgcttcattttgaaagtaagaatatgccatctaagggttaatacttnactttaggcaaccaaagggggaaaggtaaacgttacccttattttatagcttccctgtctaattctcaaagtttttatgtatataaagttgcctactatgcaaataatttgaatatgttaatgttgcctaagtgatacatctcttcatctgtatgcatgtgattaatataacctgaccaccttacgcagggggctgaaaccattgcaac

SEQ ID NO: 25581 - DNA, 487 bp, Homo sapiens
aatattacaaagttacagtaatcaaaaaagtccggaactggcataaagacagacatataaactaatgtaacagaatatagagcccagaaatacatgttcgtgtatatggtcaaatgatctttgaagatggtgccaagaccattcaatggggaaagggcagtctcttcaataaacgttgttgggaaaacagctattctctttgcaaaagaacgaagacagacccttatcttataccatgcacaaaaattacctcaaaatggattaaagatctaatagttaagtctaataggtaagacctgaaactatgaaactcacagaaggaaatatgcagaaaaactttatgacattgaaatgggaaacgatctcttggatatgataccaaaaagcacagacaacttatacaaatgtagacaaatgagactacctcaaatttaaatattttctgcatcaaaggaaacaatcagcagagtaaaatggcaacaacaga

SEQ ID NO: 25582 - DNA, 431 bp, Homo sapiens
  misc_feature 2, 19, 424: n = A,T,C or G
cnccggggtaattcggccnttatggaccggggtgcggagaaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtngaaaaac

SEQ ID NO: 25583 - DNA, 316 bp, Homo sapiens
gaccggggctctttttccggctggaaccatggagggtgtagaagagaagaagaaggaggttcctgctgtgccagaaacccttaagaaaaagcgaaggaatttcgcagagctgaagatcaagcgcctgagaaggaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcaga

SEQ ID NO: 25584 - DNA, 311 bp, Homo sapiens
  misc_feature 13, 16, 32: n = A,T,C or G
tactgtcggcaanttntggtcgcgggattgcnagaagcctgcctggggaatacagcatgaaagtgacaggagaaggatgtgtctacctccagaacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctcttggggcttttccattttccccctggaagccca

SEQ ID NO: 25585 - DNA, 426 bp, Homo sapiens
  misc_feature 15, 33, 36, 41, 224, 231, 378: n = A,T,C or G
tggcggggtgaagcnaaagcctttgccctagcnatnaagantgttgccgttaagaagaccttggatgttgttccagttatgctggattccacagtgaaatcatttaaaaccatctaaataaaccactatatattttatgaattacatgtggttttatatacacacacacacacactctgacattttattacaagctgcatgtcctgaccctctttgaattaagnggactgnggcatgacattctgcaatactttgctgaattgaacactattgtgtcttaaatacttgcactaaatagtgcactgaagaccagaaaattttacaatatttttttctctacaatatgttctgtaggaatgtttaccctctttatgaagngaattaccaatgctttgaataatgttcacttatacattcctgtacaga

SEQ ID NO: 25586 - DNA, 307 bp, Homo sapiens
  misc_feature 4, 29, 124, 200, 278: n = A,T,C or G
tctnttggcgcggggataattaaaaactnagtggaggaaggcagcccagcatcctgaaggagctgtgataaccatctccaaatgcaccatgaagctgaaggagacaaaatcaagatcaaaaccntcaaactattggaagtttcagatgaaaggaatcaagattgtggggaaatggaagcaagtgaaggtagacccaaatntgtttgtaagtggacagatggctgatgtggtatgctttgaggaactgagattactgggttggtcccctctgccaaganttcctccagtctcttctcaaaggaggcat

SEQ ID NO: 25587 - DNA, 344 bp, Homo sapiens
aatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagaggtgggaagaattgcaggaagaaaaagaatgtgaaaaaccacaaggggatgaggaagaggaggaggaggaggaagaagtggaagaaga

SEQ ID NO: 25588 - DNA, 340 bp, Homo sapiens
  misc_feature 22, 23, 73, 118, 214, 217, 220, 277: n = A,T,C or G
atttgtgaactgagctgctatnnagttgttaatttcataacttttttcatctttctgaacaagacttttcagnggccaaatagtcaggacattcaaaggtttatgtggtaatatcagngatatttcgaactgtgaaaatggacttaataattagaccatttctacaaagaacaactgaataggtggaaaacatggaatttcttttaggtgcagnggnggncttcaaattacattagttttttttatatatattttaaacatatgtaagaaattaagnggcaaagaactgagaaagcttaagacctgcttcaaaagcctgaaaaatggaaaaataaaattg

SEQ ID NO: 25589 - DNA, 461 bp, Homo sapiens
  misc_feature 4, 10: n = A,T,C or G
gtantcggcnttatggcggggggaatatgaagacagtgcctacaaccaccacatacacagtaaacattctctcttctcagtggttgaagttgttcctgattacagctctcttatctgttctccctttgatttgctgactgatggatgcagtccatttaagaaatgagcatagcatattggaaagagcactagacttagattctagtcccagttctgtcacttaacagctatgtgttgaggtgaggtgagggaagagtacttggatctctggatctcttttaactttaatattctcctctataagggtagaagatgaactagaggatcacaacagtaccatttagttttccgttcagtggcaattttgacatacttttttgagcatacataatctcagaatcctatgcctcaaaactttgattcattggacagatttcaagaaaaatataatttaacaaatg

SEQ ID NO: 25590 - DNA, 368 bp, Homo sapiens
  misc_feature 116: n = A,T,C or G
atggagaaacgacacaggttaggagacgtcgctttgaacgtgctataggaccttctcaaacacacaccatcagaattcaatattcacctgccagactggcttatcaagacaaaggngtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatg

SEQ ID NO: 25591 - DNA, 335 bp, Homo sapiens
  misc_feature 277: n = A,T,C or G
atacagactcaaggacgcagcaagtggcggagcaagaatcacactcaggcagtctctctcctttctgaacagagatgagccctaagataccctggaagattttgtttttaacctcacattaaggaaagcacacatcaccttgaaaggttgcacactttactcctatgatggtgccattgcacagaaacatttcagaatacttttctaaattaaagagtttgtggagtgttttataaatatcaatgctaggaaatctttatcaaatgaagataggttngactttttgaaacaaaagtcattcagagataagtctggtgtgattgaagccaaatcat

SEQ ID NO: 25592 - DNA, 404 bp, Homo sapiens
  misc_feature 3, 12, 67, 403: n = A,T,C or G
tantgtcggccnttttggccgggaaaagctgtagaagaaaagattgaatggctggaaagccccaagnatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaana

SEQ ID NO: 25593 - DNA, 321 bp, Homo sapiens
  misc_feature 5, 19, 27, 31, 34, 52, 97, 122, 130, 144, 165, 171, 202,226, 256, 267, 300: n = A,T,C or G
agggnaaaagattttttanccccccantggnaanaaagtggggttggggggnaattttttttttggtttttggtttttggtttttttggtttttttnggtttttggtttggtttttggtttnggtttttnggtttttttttttnggcccaccttaaaattttttnaaggtnattttccattttcctggccatttgcctaagnataaaaaaaagcctggaaaggttnaccttttaatggtttttgggcccttttttnaaatggccttncaattttccaaataattgggacaatttttggtnaagttttgaacccgggggggg

SEQ ID NO: 25594 - DNA, 216 bp, Homo sapiens
gaggcattgaggcagccagcgcaggggcttctgctgagggggcaggcggagcttgaggaaaccgcagataagttttttttctctttgaaagatagagattaatacaactacttaaaaaatatagtcaataggttactaagatattgcttagcgttaagtttttaacgtaattttaatagcttaagattttaagagaaaatatgaagacttagaaga

SEQ ID NO: 25595 - DNA, 381 bp, Homo sapiens
tctgtccggccctctttggccggggctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactg

SEQ ID NO: 25596 - DNA, 349 bp, Homo sapiens
gaaagagctcctgaaggaagcactaaatatggaaaggaaaaaccggtaccagccactgcaaaaacataccaaattgtaaagaccgtcaacactatgaagaaactgcatcaactgaggggcaaaataaccagctagcatcataatgacaggatcaggattcacacataacaatattaattgtaaatgtgaatgggctaaatgccccaattaaaagacacagactgtcaaattggataaagagtcaagacccattggtgtcctgtattcaggagacccatctcacgtgcaaagacacacataggctcaaaataaaaggatggaggaatatttaccaagcaaatggaaagct

SEQ ID NO: 25597 - DNA, 460 bp, Homo sapiens
  misc_feature 8, 12, 98, 247, 459: n = A,T,C or G
tattggcngggncagtggaagaaaagccaagaagtaaacttttacagtcgttgatttgactataacgctgatccccccaaatcaaaggtaatttcacntttgaagattgcgttctgatttgtagctttaagcgattagagaaaattgtgcaatattcccctctacctgtttgaaaataaacattcttaaaaggatgtaatttagataatgaattgctttctctgaaacttatcccttgggacacctnaaatctgattggttttcaaagcttgggggaaggaaattaattcctgtgttaagtggttggctgaacagaatgtcttgaaaggttagcctgtagcattaggagaaatacctaatgtaaacgacgagttaatgggtgcagcacaccagcgtggcacatttatacatatgtgacaaacctgcacgttgtgcccatgtaccctagaacttaaagtnt

SEQ ID NO: 25598 - DNA, 170 bp, Homo sapiens
attatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacg

SEQ ID NO: 25599 - DNA, 300 bp, Homo sapiens
attacaaaattttgggctttatctaatgatgtgctgatccataatgtttgtatacttataaatgtgttaataacttaaataacttttaaaaagtgaatcttttactgactcaattggttttcccctaaaataatttcttctggtatttgcagtcttgtaggcagttaacagactttaagtaaataactttaaaatgtttagtagcaccttgaaaaaaggcttcaactttatattttatgtaagatatactttgggaagcaaattattttgataaattatgagataaagatatggttcaga

SEQ ID NO: 25600 - DNA, 204 bp, Homo sapiens
cagccctgcccatcagaaagccttcgacgctacagcccaggattggcccactttccccattcacaaatgcctaccgcaggaatgggatggcttttctagcctgctgatgtgacaactgtgatgtgcctgcaacaacaggaaaggcaatgttatattaaggtgatttcttgtgaacaaaataaaatacaaatttacctttctttt

SEQ ID NO: 25601 - DNA, 386 bp, Homo sapiens
  misc_feature 2, 3: n = A,T,C or G
cnntggcccgggccccagatctaaccccctcagactttcagtgaaaagttctacaagggaaaaatcattgggtgattgatttctatgctccttggtgtggaccttgccagaattttgctccagaatttgagctcttggctaggatgattaaaggaaaagtgaaagctgggaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaaggatgaactttgataatg

SEQ ID NO: 25602 - DNA, 268 bp, Homo sapiens
gacataaatctgaccagaacacaagcatcttaatttgaatccacaaagtttcatgtaatgaaaagaaatacataattttaattcaacccgagtgttttccaagaagattgtatttgcttaaattgctacagtaattcaagagacagccctgtctggacacagagttactgtggatttttaagagactcagttaaagaatttaggaatttctgattcatttaaaggatttacaaattcatcaacccctgaaaactaaagcaaattgaac

SEQ ID NO: 25603 - DNA, 366 bp, Homo sapiens
  misc_feature 354: n = A,T,C or G
taactacattcttccctgcacaagatgattaatacagatcttagcagaatcttgaaaagtccagagatccaaagagcccttcgagcaccacgcaagaagatccatcgcagagtcctaaagaagaacccactgaaaaacttgagaatcatgttgaagctaaacccacatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaanaagcctctggtg

SEQ ID NO: 25604 - DNA, 248 bp, Homo sapiens
aatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagcctgaagatgatgaggatgacgatgtcgataccaagaagcagaagaccgacgaggatgactagacagcaaaaaaggaaaagttaaact

SEQ ID NO: 25605 - DNA, 399 bp, Homo sapiens
  misc_feature 17, 343: n = A,T,C or G
agagaagattcccgagngtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgctttcgaagtattcaatactgtaggaacaagcatgatcttgttactgtgatattttaaatatccacagtactcactttttccaaatgatcctagtaattnctaagaagtatctttctcttacctgttatttatcaaatttttcccagtatttttat

SEQ ID NO: 25606 - DNA, 413 bp, Homo sapiens
  misc_feature 15: n = A,T,C or G
attctgggtcacagnatataaggtatttaaaatctatttatgctttatagagaaaccagacattaaaacttcatgcactacttatttcgaattactgtaccttatccaaatttacacctagctattaggatcttcaacccaggtaacaggaataattctgtggcttcatttttctgtaaacaactgaaagaataattagatcatattctagtatgttctgaaatatctttaagactgatcttaaaaactaacttctaagatgatttcatcttctcatagtataggagtttactttgtacacgtttgaaaccaactactgtagaagatgaggaatctattgtaatttttttgctttattttcatctgccagtggacttatttgaaattttcactttagtcaaattatttttttg

SEQ ID NO: 25607 - DNA, 396 bp, Homo sapiens
tgcttagaaggaaggacatatgacatgaggggagccacttctgaataagatctaatgttggaaatttttgtttcttcctctcagttccttcattttttttcacatcgatcctatctaccagcccaaaggtggagtgtatttcaggggagcatattgggccatagtactggagaatgtttgctgacccacaatttagggtctcacttaaaatcctagttctgccatttcctagctgtatgtaccgaggtaaattattccatccagttgcatctctttttatcttcctctgttaaataatagtatactccacagagagctcctgtgagattaaatgagctatgcacgtgatgttattctgttacctaaaatggagaccagtgtttgtctaatggagtg

SEQ ID NO: 25608 - DNA, 418 bp, Homo sapiens
  misc_feature 10: n = A,T,C or G
gattctaagnatttggtttgggatcaataggaaagcatatgcagccaaccaagatgcaaatgttttgaaatgatatgaccaaaattttaagtaggaaagtcatccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaaga

SEQ ID NO: 25609 - DNA, 340 bp, Homo sapiens
atgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtgggggtctcaataaaagttat

SEQ ID NO: 25610 - DNA, 446 bp, Homo sapiens
gagctaatccctgaatatctgaacttcgttagaggggtggtagactcggaggatctccctctaaacatatcccgtgagatgttgcaacaaagcaaaattttgaaagttatcaggaggaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttaagaagtgatctatatgaattgag

SEQ ID NO: 25611 - DNA, 416 bp, Homo sapiens
  misc_feature 2, 6, 42: n = A,T,C or G
tntatncttggtatcaaaacaaagaccagcatatagtcaagnaagatcatccaagatattgacctctgtgaaaacagcgtgcagcggcacattggacatgctaacctcaccttcgagcagcttcgtagcttgatggaaagcttaccgggaaagaaagtgggagcagaagacattgaaaaaacaataaaggcatgcaaacccagtgaccagatcctgaagctgctcagtttgtggcgaataaaaaatggcgaccaagacaccttgaagggcctaatgcacgcactaaagcactcaaagacgtaccactttcccaaaactgtcactcagagtctaaagaagaccatcaggttccttcacagcttcacaatgtacaaattgtatcagaagttatttttagaaatgataggtaaccaggt

SEQ ID NO: 25612 - DNA, 240 bp, Homo sapiens
agaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaatatttggtttatttggcactactgtaagttttgtttttcacaaagctcttattatgaagcaaaataaaaattctagtttcttac

SEQ ID NO: 25613 - DNA, 205 bp, Homo sapiens
atgttaaagttttgcgaacttaaagggctgactttagttccttcatggtaatggcttgagtaacatcatctttgggattttttaaatactggtccagtctaggagaacctggaagatgaccagaggtatttcagtttccctagggagagcttcgttatccatgtggatgataagtctgcttgatttattattaaatcattatagc

SEQ ID NO: 25614 - DNA, 460 bp, Homo sapiens
  misc_feature 7, 424, 456: n = A,T,C or G
tcggccncttattggccgggggtataggtgatggcatgtctttatggtagcaaaaaatatatatattatagctagaaataaaatagacagcaaacatgcaaacctttaaaaacactttggaagacctaaaaatactgatataaacattactagaagtctgtataggtatccattctcatcaaaaacagtgtaataaaagcccagtcaaaatctcagtgagactattttggggacacttgacagaatgattgcaaagtttagaataaacatgtaaaggtggccaggaaaatgttgaaaaaggatgaagataagggaggaaagggggccgaagaccatctatcaagcattaaaaggaattgtaaattaaaagagtgtggtactggaaccagaatagaatgacagattaatgaaaataggagtaggncagtcagaaacacatctgtgtatgtattaaanaaga

SEQ ID NO: 25615 - DNA, 442 bp, Homo sapiens
  misc_feature 5, 10: n = A,T,C or G
aattntggancgagttttcgctgaatggagtgccatagaaaaaagaaatgggtgatggactgcagagtgctggtcatcatatggatgtgtatgcatcttctattgatgatattttggaagatgaagaacattatgcagatcagttaaaagagtatcttttttaggcagaagcattgcgggctgtgtgcaggaaacatgaacttatgcagtatgacttggagatggctgctcaggacttagcatccaagaagcagcagtgtgaggaactggtaactgggactgtgagaacattctctttgaggggaatgactaccaagctctttggtcaagaagctccagagcagagagaagccagaataaaggtgctagaagaacaaataaatgaaggagaacaacagctaaagtctaaaaatctggaaggcagagaatttgtgaaaaacgc

SEQ ID NO: 25616 - DNA, 381 bp, Homo sapiens
cagaaaaaacttttcaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagaga

SEQ ID NO: 25617 - DNA, 398 bp, Homo sapiens
aattaaaatgctaggtttcctgtaatcgcaatcttcagggaatttttcactcaagcccagaaaataaactccagataatgatactgagaaatttattggttggaaaactgctatctacaggccttccactacctatttcttagtagattttacatttttaaagggttgtagaacaccaaaacaatatatgacagatactgtgtttgggccttaaagcctaccctttatataaaaagtttgttgactcctaggctctcatttgcaagtagacaaatgagaaacagcaaatatttaaggaaaagagcaacatgaaaaatacacagcaaacttaacaagcagaaagaattcctggggaaacaattcagggggaaaaaatgaccaagtataattagtattat

SEQ ID NO: 25618 - DNA, 353 bp, Homo sapiens
  misc_feature 2, 14, 36: n = A,T,C or G
tngttgggcatgcncctgcaccacggctcctagaanacgctgacctggctctcggaaacgcaggagtccttcctggtagccagctcagaatacccatgtagcagcaacttgaacgaatgtcacaacttgtacgttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagttcttctgatgccaatctcaacattgtctttttaatactgtcaccagatattgccatttttctttttgttaaaagattat

SEQ ID NO: 25619 - DNA, 312 bp, Homo sapiens
  misc_feature 1, 2: n = A,T,C or G
nncccccaggaagtagccagaatctgaactccctacttatcaatgaagaaattgaaaaacaaatccaggatttgtacttgatctccttatcttcccctattgctgccaaccgattgtttccacgtgggcagaggttcttaagctttttgttctcaagtcccattttaccttcttaaaaattattgaggcatctgaagagatgttatttatgtggttaattgtattaatagcactttgggaggccaaggagggaagatcacttgaggccaggggtttaagaccaacctaggcaacatggcaagaccacatctc

SEQ ID NO: 25620 - DNA, 359 bp, Homo sapiens
  misc_feature 11, 12, 351: n = A,T,C or G
tattccggccnnttattggccgggatctatgaaaaagcaagcctaccacaaggaatataggcagatgcccagaactgaaattcgaatggcgaggatggcaagaaaagctggcaacttctatgtacctgcagaacccaaattggcgtttgtcatcagaatcagaggtatcgatggagtgagcccaaaggttcgaaaggtgttgcagcttcttcgccttcgtcaaatcttcaatggaacctttgtgaagctcaacaaggcttcgattaacatgctgaggattgtagagccatatattgcatggggggtaccccaatctgaagtcagtaaatgaactaatctacaagccgtggntatggcga

SEQ ID NO: 25621 - DNA, 148 bp, Homo sapiens
gccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgattttt

SEQ ID NO: 25622 - DNA, 310 bp, Homo sapiens
agagacattgtaataatttaacaagcctaagcaggtgataggacactcctttgtaaattaagcctctaatctttctttatgctcatgccgatttgagagaaacctgggaatttccttttcccccattaggctattacacaacttaatgcttggaaaattcttcacaggaagaaacagggtgtaacagtttttgtgaggcatcttttaaaaatgcacccttttagctgaagtctgactatacaattgcctctccacctctttgctctagtttctttttgagagtcttaatttctccacataattatatact

SEQ ID NO: 25623 - DNA, 381 bp, Homo sapiens
  misc_feature 215, 260: n = A,T,C or G
actgagggttgttaacaaagtctgtggctaatctcttttgcttttcccttttaaatgacttggtcttttgtgtatccaaaggatttttttttcacattaaaaaaaaattctaggctgggcgcagtggctcatgcctataatcccagcactttgggaggctgaggtgggcagatcacttgaggtcaggagtttgagaccagcctggccaacatggngaaaccctgtctctactaaaaatacaaaaattagtcaggtgtggnggcatgtgcatgtggtcccacctgctcaggaggctgatacaggagaacgtgggaggtaagaggttgcagtgaactgattgtgctgctgccctccagcctgggcaacagagcgagactctat

SEQ ID NO: 25624 - DNA, 218 bp, Homo sapiens
  misc_feature 218: n = A,T,C or G
aaccctatttatacaaagggggaaagaaacacattcaaaagctagcagaaggcaagaaataactaaaatcagagcagaactgaaggaaatagagacacaaaaaacccttcaaaaaaattaactaatccaggagctgtttttttgaaaacatcaacaaaattcatagaccactagcaagactaataaagaagagaagagagaagaatcaaatagatccn

SEQ ID NO: 25625 - DNA, 115 bp, Homo sapiens
  misc_feature 82, 106, 110: n = A,T,C or G
taattcggccttatggcgggggaggcattgaggcagccagcgcaggggcttctgctgagggggcaggcggagtttgaggaanccgcagataagtttttttctcttngaangatag

SEQ ID NO: 25626 - DNA, 281 bp, Homo sapiens
gcatacagcagcacataaaacgcaaaactctaggacataaaaagtggcattcggacgatgttgctctgaaatttatgcattaattaaaccggtatatatgtatgcattaattaaaccaatatttatgaagttcctactgtgttacagacgtggatccaggcactgaggatgcagcaggccatccaaatataaagttacttccttaggaagcttccattctaatgggagagtgttgttaaagagatatataataatatggtaaaaatgaatccataatggtg

SEQ ID NO: 25627 - DNA, 297 bp, Homo sapiens
  misc_feature 3, 9, 121, 136, 182, 230: n = A,T,C or G
ganagtggntattcatttactttttaaaatacactgggtaaatcacctatacttagagtaacagttggttatcaaaatgcctgataaaatatattcttaataaaagtcttcatttcataangaaatcaatttattnggcatcttaatatattttttttagattcatcaacagaccagttttngggggcatatatatatacacgtgcaaatatcagaattgttaataattngttacacatgggacatttgttccaaactgactaaaaatcaatatagatattttatatacatatatat

SEQ ID NO: 25628 - DNA, 473 bp, Homo sapiens
  misc_feature 53, 388, 407, 438: n = A,T,C or G
gactgtcttaaagattatgctagctttagaacacatgcaaacagctgcagctnctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtaggaaagttgctttatttaaatttgtactgtagaatgtttgtgatacagtatttgtaaaattgatatgaaaaataatttctcaaagtctattgtttgatctagttattttaataaaggactctagaagtttcaagtggccagtgaagtgtgaggaatagagagtaaaggaaataattaataaatggngaccctctgttaagggggnttactttttccattaatataaatttcatttnggaaagattaaaaaaccaggtttgattggaccttg

SEQ ID NO: 25629 - DNA, 444 bp, Homo sapiens
  misc_feature 13, 92, 118: n = A,T,C or G
aaactttaaaagnatgaatttgctttctcaagctcagtcagtggcagaagtggggcatgagacaggccttaacttctcctttcattgcaganccatatgtgatttaatatggcagggnattcaaggaaacccaagtgacttggattccaagttatttggaatatttctgtcctgttgtttttggtctgctttctaaaccacacggttgtgatcttcttccttcgatagtacattttaactcttcttattgaaattgaaggacacatggattccttgctccccccatgtcatgtgcatgtcagatttaatcaggttatctttggaagtcacagccattctgtaggttcagtcactcttggtactcatcagtagaaactaacagataagtctccctgaatgttctaaaataaatgtttctatgaatccagaaagtcataatagatt

SEQ ID NO: 25630 - DNA, 348 bp, Homo sapiens
gccctttccggcggtgacgacctacgcacacgagaaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccattctcaataaacacattttggat

SEQ ID NO: 25631 - DNA, 471 bp, Homo sapiens
tggtgtcttttattaagaatttactccccccatttctcacagaagaaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgtta

SEQ ID NO: 25632 - DNA, 469 bp, Homo sapiens
aggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtagggagagaagtggggtttataaatgttttctctaagatatctttgctgctttccagactttgaaactattaagcttcttaactgcctcttaccggaaatact

SEQ ID NO: 25633 - DNA, 473 bp, Homo sapiens
gggaagctctgtttggtgctttggatccatttccatcggtccttacagccgctcgtcagaactccagcagccaagatggtgaagcagatcgagagcaagactgcttttcaggaagccttggacgctgcaaggtgataaacttgtagtagttgacttctcagccacgtggtgtgggccttgaaaaatgatcaagcctttctttcattccctctctgaaaagtattccaacgtgatattccttgaagtagatgtggatgactgtcagatgagaaaactgaaacacagaggttgttcatgaagtttcagatgttgcttcagagtgtgaagtcaaatgcatgccaacattccagttttttaagaagggacaaaaggtgggtgaattttctggagccaataaggaaaagcttgaagccaccattaatggaattagtctaatcatgttttctgaaaacataaccagccattggctattt

SEQ ID NO: 25634 - DNA, 345 bp, Homo sapiens
gagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatggaagtagatgctgatggtaatggcacaattgacttccctgaatttctgacaatgatggcaagaaaaatgaaagacacagacagtggaagaagaaattagagaagcattccgtg

SEQ ID NO: 25635 - DNA, 298 bp, Homo sapiens
aaggtagactttgctttgaagtgaagtgagataccttctaaagcaaaagtctgtttaatattttccaccattagaaaaaatgcgtgcttaggccaaagtgcaagaagaggaattccatgtggaaaactgcaggtgtgtctagttaggccaagaggtataaaaggctgagcagttgtctggcacacctggtatttgcaccatcagcatcttgcacttagtggatgctaagcaaatatttgtgatttttttcaatagcagggatgtttgtctgaatatttaaatattcaccttagtttga

SEQ ID NO: 25636 - DNA, 340 bp, Homo sapiens
ataacagctttatttataatagccaagagtggaaacaacccaaatgtccatcaacagggaatggataaacaaatagtgggatatccattacaatggaatacgcctcagcaataaaaatgagtatactattggtacgcacaacaaaatggatgaatctcaaaatagttatgctgagtgaaagaagccaggcaaagaagagtacatgctgcatgatgtactatttatataatttataagtatacatttatattaaaattcctagtgaatgcaaattataatgacagcagaacagtggttgcctggggacaggagcagtgtagttgtggaagggagagattac

SEQ ID NO: 25637 - DNA, 473 bp, Homo sapiens
  misc_feature 15: n = A,T,C or G
agttcagggactagnacttcagccctgggaaggaagctgccaaaaagaagcagtgtccttgtcttagatatgcaaggccctaagctctaaacaaaagacagacgtaggcattgctgtcagacctgcgtcatcagatttcagccagaatcacatcaggagtaaatatgccagattccacttgaaatgatgattagccttgggtaagaaccagaggagcttagctgtgaggagggagactgcttagcatggctagccaggatgggcccagcactaaaagcacaaagttgtagactttaacgtcaaagggccaattaaagtgaaacgaatgaggcctgttctcatatcagcactgaaaacgtgctgctggtctgttacctgaacaaatatcttctctgatccatattggaaaaaagtaagaaggcaatatacatttctctctgtctctgcaataactaaaaactcctgcctttgat

SEQ ID NO: 25638 - DNA, 471 bp, Homo sapiens
ctgaagaaactgcaaagtgcaattccaaaagccaaggtgagaaagaaatgtatacgctgggaatcactaattttcccattcctggagagcctggttttccacttaacgcaatttatgccaaacctgcaaacaaacaggaagatgaagtgatgagagcctatttacaacagctaaggcaagagactggactgagactttgtgagaaagttttcgaccctcagaatgataaacccagcaagtggtggacttgctttgtgaagagacagttcatgaacaagagtctttcaggacctggacagtgaagggagcccgggcagccaccgtctccagagccctgggcagcattttccagcaagatgtacacaatcttttgcctttatttcgtaaagttttatacagaagagagaagagcatgtctttacttgaaaaactcttgatcaagaatttgggtgggagaaaagaaagtgggtt

SEQ ID NO: 25639 - DNA, 468 bp, Homo sapiens
  misc_feature 462, 464: n = A,T,C or G
catagaaaattattgtaaaagatcatttcttcacaaattccttcaccaatggaaacctttaatatcttgaagatgaatatccatgtctgtaaatgttaagccactttaataaatcattcaatcaaatttacttcatattaatcagatgaaatcagttccttttcaaaatttggagatttggaaaccttaaaatttttatatttggctggtcttcaaataataaaataaaataaggaataaaaacagccgacccaatttaaaatttaaaaaaaaatgtcttaagtcatatctgggtttcctaacatgtatgccaaggctcagctatttatcaatgttatatagctgactgaagatttaagtctcccaaaagcaaaacttaaattggaaacttagagaaaatttcaactattgttacccgcatgtttgggtgttagccgtgaacctaaagacaaaaggtgttgngntttg

SEQ ID NO: 25640 - DNA, 367 bp, Homo sapiens
  misc_feature 6: n = A,T,C or G
aataanaagggaatttgggtaaagaaaggaatacttttgttagaatgagaattaaagagaaaacaaaagaatcttggcaaaattttccctctgaaattacaaactttaggaacttttccagatgtatcgaatttaatttgacattgatgtcactcttcataccaagtgaatctattctcatgaactttgaacccatgttaattttggaccctataactaatttcctttctgtatcccatggtggtcaaagcagtaaaggagtttagagatacttagcaaatgccattcatatagtattgttagccaaactattattccttccttagaagttgatgtatcaagaaaatttataagttatttgtattta

SEQ ID NO: 25641 - DNA, 324 bp, Homo sapiens
  misc_feature 23: n = A,T,C or G
gaagacatttttaccaacatagnaggcagatctcagagcagatccctcttggttaatgcaagaccaaatttccttgcagctgaacagaactgccaccacattcagtacattacaaatccagtactccagtgatgctcaaatcactttaccaagagcagagatgaggccagtgaaacacaaatggactatgatttcaagggataacaatactaagctggaacatactgtcttggtaaggtggaacccgttggcctgaactgcccaggccaaggagaccccaccccacacgtggattggcttctagctgatggaagtaaagtgaga

SEQ ID NO: 25642 - DNA, 134 bp, Homo sapiens
tggcgcatgcctgtaatcccagttacttgggagctgaggcagggggattgcttgaactcgggaggcggaggttgcagtgagctgagatcatgccactgcactccagtctggcaacagagcaagactcttgtctc

SEQ ID NO: 25643 - DNA, 406 bp, Homo sapiens
atttgattaaaaaatgcttatttttgaatttttgttttgccttttgctctgcatcatttcattcttaccctatacaaatctgatcattccttcccttgaggagggaaagaggcttcttgcttataaggagttttcagaactggtacgtggtaagagaaagcatcccctgcaggtgatatctcaatcaaaggaggatcgactgcagagctaagttgagtgaggagctaaggttagttaggcaactgagcaagtcattagacgaaagcaagtttaagatccagattaagagtccaaggaattggagagacagaaagatgagagctgggcattgaaagtctctctagagaggaatcaagaggatgggcttgcacaggcctttgggatagtgttgctgggaaagaagggt

SEQ ID NO: 25644 - DNA, 184 bp, Homo sapiens
gagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaat

SEQ ID NO: 25645 - DNA, 262 bp, Homo sapiens
  misc_feature 1, 23: n = A,T,C or G
natataaggaatcccattaaagnaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattattttttgtttcctgacttt

SEQ ID NO: 25646 - DNA, 104 bp, Homo sapiens
  misc_feature 4, 95, 99: n = A,T,C or G
attncttccccctttcctctcttcgtgttttaaggaagaaactataaattttttttaccccatgaatttttaaagaactattctaaacattggtngaangaaac

SEQ ID NO: 25647 - DNA, 431 bp, Homo sapiens
  misc_feature 12: n = A,T,C or G
atagtcttccgnacctaaaatgctcaccgttcactctctgctagtccagttcttttaatgcttgccttaaccttccctgaggttttctaatttccctagccagaaacaatcttttgaactcttgtggaatttttaaaactactttttttaccattttaaataagtggcacacatgttattaattagatatgcccagtatgtaactacttgtgttcagatgtaaggaccctaatttaatgtaagctttttgagggcagggattgcctcatatatcttactgtctgtttggtttctaacttagtgccttaagagcttgttaatgtgtctttccacgactagactgtgaactttttgggagcagggaccacagtttaatggcatttgtgatggcagtgtcaggcatctagaaggtactcagtaaatgtttattg

SEQ ID NO: 25648 - DNA, 450 bp, Homo sapiens
  misc_feature 21, 436: n = A,T,C or G
accggccgggaccctaagagntgaataaaagctattaaagaataagtttacttaactattccagttaccatgaaccgtattgaagtgttactcatttattgtaatcagaattatcactatttttacctgttatctttccctggatacatctgagtatattcaactctgtattttttggcaaaaagcatgaaggcattcattggtcttttgcacttattagggagaagtggcactcacagtccctgagctgtggtttttgacagctttagcatacaaagaattggaaaagagctgtgatgatccaggtgagccacagtttttactgaatccagatcttgcaaagtcttgaccaccaggtcctccacaagacaaagatgcacgacgctggcgaaccatactacttaacacataaactgcagaagaatccataggtggngaagtcatagctat

SEQ ID NO: 25649 - DNA, 452 bp, Homo sapiens
  misc_feature 22: n = A,T,C or G
gacacatgtgacaaaaacaagncaatggggaaaggattccctatttaataaatggtgctgggaaaactggctagccttatgtagaaagctgaaactggatcccttccttacaccttatacaaaaattaattcaagatggattaaagactgaaacgttagacctaaaacgatgaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaaccttacaaaatgggagaaaattttcgcagcctactcatctgacaaagggctaatatccagaatctacaatgaactcaaacaaatttacaagaaaaaaacaaaccac

SEQ ID NO: 25650 - DNA, 374 bp, Homo sapiens
ataatgaattaactagaaataactttgcaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccta

SEQ ID NO: 25651 - DNA, 405 bp, Homo sapiens
  misc_feature 14, 24, 30: n = A,T,C or G
ccccgaaggggggncggcccggcnccctcnggccggggtttgagcccaggggttcaaggtttgtgtgagccatgattgagtcaccacactgcagcctgggtgacaaagcaagatcctttctctaaaaaaagaagaggcgaattttggatgatcttgcctgcgtctgagtactgactcctccactcactgaaagtcactttggccaagtgacttcgtgtttttgtgtctctgcccccacaccagtaaaatgggaataataataagatatctttgatggactgttgtgataaatgagaaaatcagtgtaaagtgcttggagatgtgcctagtgcagagtgggcacttgctgaatgttaattatttgtataacttgctggtgtgggaagcctgactcttctccggctg

SEQ ID NO: 25652 - DNA, 209 bp, Homo sapiens
  misc_feature 36: n = A,T,C or G
attctcagccttttgggcatatgtatctttataatnagactggaaacgggactttctattaatatcattttcagaataaaaaataggataatttaacctaccagcccttctcccccaataactgtggtctatacagagtcaatatattttttcagagaaagttattcgctcgattttttctgaatcataattaaactttatgataaaat

SEQ ID NO: 25653 - DNA, 294 bp, Homo sapiens
atccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagggaagaccagtgccaaccctgagactctgctgggggagatggaggcgaagacaagagagctcattgctagaagaaccacacctcttttggaatatatt

SEQ ID NO: 25654 - DNA, 272 bp, Homo sapiens
  misc_feature 2, 5: n = A,T,C or G
anaanaaggccgggtgcccaattgagtgcttcatgcctttagaatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcat

SEQ ID NO: 25655 - DNA, 379 bp, Homo sapiens
  misc_feature 4, 5: n = A,T,C or G
cccnntggcccggggagtggatgctaggcctgagaggggtgagaaaaagctgaggaggagctgtgtgtctaggaaaggcaggagacaccaatgcactatctttctagattctcctgctgccatgctttctagaattattttaaatatttcagctcagttattctttcctgtaactttagaagaaatcattctgtgaatttttcttggggtgggggaaggaggtaaattagcatctttcaaatatttactcatggaagatatggctctatattaattcaagccttctttattataagtttcattattttttatgtataaagtcacacacttttctcattaaggttttttcagatacttggtatgaatcgtatttctttta

SEQ ID NO: 25656 - DNA, 360 bp, Homo sapiens
  misc_feature 2, 4: n = A,T,C or G
cncnggccggggataatgaaaggtatcagttgtgttgagtggagggagtttaagagaaaggacccttcccaaccagcagccagtagaaaatacaacctactcacctttttcccttctaagttctgctaaatcacatctgcctcatagagaaaggaatgttgcctttgagaactgtcttggagaacagataagcttgaaatgttctctctagagaggacatagggtttgggatcctctgaaaaggcccagaaaaatagctcagttcaaatacaatgttctaggacaattggaatataaatattgtccaaaaatataattaaaagaaaaaagtttagcactgtgtaaagtaagtgttaactg

SEQ ID NO: 25657 - DNA, 432 bp, Homo sapiens
gtcatcaacacatggaacattctccggatagaccatatgttaagacacagaacaaggctcaataaaattttaaaaattaaaatcatatcaagtatcttctcagaccacaatggaataaaacttgaaatcaataagaagaagaaatttgcaaactgtacaaatacatggacattaaacatgctattgaataatcattgggtcaatgaagaaattaagatggacatcaaaaattttttttaaacagaaaatggaaacacatcatgcaaaacctatgggatacagcaaaagcagtactaggagggaaagtttatagcaataaatgcctacaccaaaaaagtagaaagattttaaataaacaacctaatgatgcacctcaaggaattcaaaaagcaagaacaaatcaaacacacaattagtagaaagaaaaaatat

SEQ ID NO: 25658 - DNA, 397 bp, Homo sapiens
  misc_feature 2, 32, 266, 279: n = A,T,C or G
tncgggcgcggggaaaaatcacctggcaaccntgggtctcgcttatgaagttacaaaatcttcagcttcagcccaggcaaccgctaagcctctgaagaactccctttggctacttttgaaaatcaagatgagatactattagatatatatccatacatttttattgtcagaataaaattaggaacagtaaaatccaaagaactatgtaaacaaaaaagcttttgttttgcttacaaagtatatttatgggattattctgctgaagnattcagtttaagnagttttccttgggagaactaagtaagaaacacaatgccaacagctggccagtaattaagtggttgtgcactttcatgtcattaatcaatttctcaatagttcttaaaattagtggaga

SEQ ID NO: 25659 - DNA, 252 bp, Homo sapiens
  misc_feature 6, 91, 94, 97, 112, 166, 199, 207, 209: n = A,T,C or G
cagccnagcgcggggcttctgctgagggggcaggcggagcttgaggaaaccgcagataagtttttttctctttgaaagatagagattaatncanctncttaaaaaatatagncaataggctactaagatattgcttagcgttaagtttttaacgtaattttaatancttaagattttaagagaaaatatgaagacttanaagagtancntgaggaaggaaaagataaaaggtttctaaaacatgacggaggt

SEQ ID NO: 25660 - DNA, 405 bp, Homo sapiens
  misc_feature 14: n = A,T,C or G
aacatacacaaatnaataaatgtaatccatcacataaacagaaccaatgacagaaaccacatgattatctcaacagatgcagaaaaggccttcggcaaaattcaacagctttcttgctaaaaacacgcaataaactaggtattgatggaacgtatctcaaaataataagaactatttatgacaaacccatcgcaaggaagctaaaaaccctgaaaaaagattagatgaatggctaactagaataaacagtaaagagaagaccttagatgacctgatggagctgaaaaccatggcatgagaacttcgtgaagcatgcacaagcttcaatagctgaatcaatcaagtggaagaaagggtatcaggtaactgaagatcaaattaatgaaataaagcaagaagacaagg

SEQ ID NO: 25661 - DNA, 366 bp, Homo sapiens
gattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggaacaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaaga

SEQ ID NO: 25662 - DNA, 399 bp, Homo sapiens
  misc_feature 9, 18: n = A,T,C or G
gaccggggnattgacagnaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtggttgaataaagaaacagaaaaaatagaacatactgaaaataatctaagttccaaccatagaagaagctgcagaagaaatgaaga

SEQ ID NO: 25663 - DNA, 376 bp, Homo sapiens
  misc_feature 16: n = A,T,C or G
tagatatagtaccgcnagggaaagatgaaaaattataaccaagcataatatagcaaggactaacccctataccttctgctaatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtaggagagag

SEQ ID NO: 25664 - DNA, 267 bp, Homo sapiens
  misc_feature 8, 16, 24, 29, 30, 265, 266: n = A,T,C or G
ggaagggncttagttnaaaaaacnaagannaaactgctctcactttaaatttgtggtgtctgtgagatgtgcacctaagtcagatgctctttgccatgcagtaaaagacaaccctatgtgaatttagaaaggggagcccccctttctaatgctacattcaaagtagcattcttagcacaatttagacagtgccttctctggagaggtaaatgaagaaatcacaaactagaaaaaaagaaacaatatctacagaacaaacacagcnna

SEQ ID NO: 25665 - DNA, 316 bp, Homo sapiens
  misc_feature 2, 11: n = A,T,C or G
cnggccggggnaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaagataaaaggtttctaaaacatgacggaggttgagatgaagcttcttcatggagtaaaaaatgtatttaaaaga

SEQ ID NO: 25666 - DNA, 489 bp, Homo sapiens
  misc_feature 2, 430: n = A,T,C or G
cncactctggccgggattagagaaaagcaaatcaaaaccacagtgagataccatctcacaccaactataatggctattgttaaaaagtcaaaaaataatagatgctggcaagggttgtagagaaaaaggaatgcttatacactgttggtgggagtgtaaattaattccacattgtggaaaacagtgtggcaattcctcaaagacctaaagacagaaatagcatttgacccagcaatcccattactgggtatatacctaaaggaatagaaattgttctgttataaagacacacatgcatatgtttttgagtttttaaaattgtttgatagttgaagcaaaaattatgacaagatctgtttctgaatgtatagtgaggaattttgaagacaattaggaggaagaaaggattaaacataattggaggtaaggnttctacatttcactcaaagtgataaaacattgataccagtagattatgatgttacttat

SEQ ID NO: 25667 - DNA, 367 bp, Homo sapiens
  misc_feature 353: n = A,T,C or G
ctggccgggggctatgtagatgattaaggatatgtgaagttcataatttagtaacttcctaatttaataagctcaaagtctaattatttagcaacttccactatgtccttgtatgtggaatttgagaaaatacggaaatacttagtcttggcttttagaaataatcacagaaaaacaacatggagtagttatttataaaataagatttaatttcaaatggaataatctagctatgtttacatttctcaagaaaaatagaattgttcccttagaagttttaaaagcaggcactatctgtcaaagttttaccatggctgaaatttttaacattgaatttagtactttaaattggngaaactatgggagg

SEQ ID NO: 25668 - DNA, 188 bp, Homo sapiens
  misc_feature 4, 16, 41, 188: n = A,T,C or G
cagnaggaacgattgnagccattgtcacaggaaccaatgcnggaggctttataaaaacacatttttggtcgggcgcggtggctcacgcctgtaatcccagcactttggcaggccgaggggggtggatcacaaggtcacggagaccgagaccatcctggctaacatggtgaaaccccgtctctactaan

SEQ ID NO: 25669 - DNA, 240 bp, Homo sapiens
  misc_feature 3, 4: n = A,T,C or G
cannctggccggggacaacccttagccaaaccatttacccaaataaagtataggcgatagaaattgaaacccggcgcaatagatatagtaccgcaggggaaagatgaaaaattataaccaagcataatatagcaaggactaacccctataccttctgcataatgaattaactagaaataactttgcaaggagagccaaagctaagacccccgaaaccagacgagctacctaagaacagct

SEQ ID NO: 25670 - DNA, 394 bp, Homo sapiens
  misc_feature 7, 11, 25, 35, 189: n = A,T,C or G
aaaatgnggcngggggaggcgaagnaacgcaaagntgagaacatggacgttaatatcgccccactccgcgcctgggacgatttcttcccgggttccgatcgctttgcccggccggacttcagggacatttccaaatggaacaaccgcgtagtgagcaaccctgctctattaccagaccaactacctggnggtggctgccatgatgatttccattgtggggtttctgagtcccttcaacacgatcctgggaggaatcgtggtggtgctggtgttcacaagggtttgtgtgggcagcccacaataaagacgtccttcgccggatgaagaagcgctaccccacgacgttcgttatggtggtcattgttggcgagctatttccttatctccatgtttg

SEQ ID NO: 25671 - DNA, 307 bp, Homo sapiens
  misc_feature 106, 150, 219, 274: n = A,T,C or G
gaggcattgaggcagccagcgcaggggcttctgctgagggggcaggcggagcttgaggaaaccgcagataagtttttttctctttgaaagatagagattaatacanctacttaaaaaatatagtcaataggttactaagatattgcttancgttaagtttttaacgtaattttaatagcttaagattttaagagaaaatatgaagacttagaagagtancatgaggaaggaaaagataaaaggtttctaaaacatgacggaggttgagatgaancttcttcatggagtaaaaaatgtatttaaaaga

SEQ ID NO: 25672 - DNA, 429 bp, Homo sapiens
  misc_feature 170, 194, 327, 330: n = A,T,C or G
gggttcgatagggagaatcaggacactgtgcacatgcctaaggtttcaccttcaagaagtagtattagagactacacactgttgggggaaaaggacttcactgaagtagcccatccaatgcggtaaacaagtaaacaagtatatagtgcaacaacaagaagtccttgggngggggattaatcagtattcaaagngtctaaaatatagtatctaaaatgtctggttttcaacagaaatttaagagacatcaaagcagatcatagaaattgtctttcaggggacctggatgtgagacttaccagaaaaagacagcaaagtagctatttnttnttttgttcaaagaactaaaggaaactatgctgaaaaaattaaaggcatcatgaaaatgtcttaccaataggtaataccaataaaaagatataagttatg

SEQ ID NO: 25673 - DNA, 320 bp, Homo sapiens
  misc_feature 10, 11, 123, 126, 144, 239, 294, 318: n = A,T,C or G
tccggccccnnctggccggggaggcattgaggcagccagcgcaggggcttctgctgagggggcaggcggagcttgaggaaaccgcagataagtttttttctctttgaaagatagagattaatncanctacttaaaaaatatagncaataggttactaagatattgcttagcgttaagtttttaacgtaattttaatagcttaagattttaagagaaaatatgaagacttagaagagtancatgaggaaggaaaagataaaaggtttctaaaacatgacggaggttgagatgaancttcttcatggagtaaaaaatgtntt

SEQ ID NO: 25674 - DNA, 267 bp, Homo sapiens
gaccgggaatcctaacaagtaaaaagctggaaaaatggaaaaatgaacaattcttagatttgtaagagaagtgaggtcacagggcaaaccactggccccaaaatcagcgagagagacacgtatagagaatcataacttaccagagcagaaacccatgagcagaaacctccaagggaaccagtgccaaactggaaaaacctgaactgtaattaacaaattgctggaagctcaatgtggacaagtcagagagtttgaaacttcagaggg

SEQ ID NO: 25675 - DNA, 372 bp, Homo sapiens
  misc_feature 7, 19, 27, 63, 134, 287: n = A,T,C or G
gcggggnagaagccacagnatattggntttggtaatcgatgtggaaaacccaaaggaccaagnagatccaccttcagaatggacatgattcagggagctagaagacactttaagttatactggaaaattcaggngccactgaaagccagatttatagtattccatctttaatatgtgggactaacagcagcgtaggattgttaccttaatattttttgctgggaccatctacctgccttatactacacttaggaaaaagaattacatatggtttattttgaaacttnaagtattattgccttaatgtctcttaaccctgttacacgctgcttgtagacatgttaatatagtaatacctttatgatatattga

SEQ ID NO: 25676 - DNA, 305 bp, Homo sapiens
  misc_feature 76, 215, 259, 294: n = A,T,C or G
atttgaaaactttgattctggaacctttaaaactaatctcagtaaaaatttttggtgcccatgcagctgtagttgntcactgctttcctggatggatgggactcttatgtcataacttctgttactcctttggcccatagctaaggtcatccttccccacagaggtggctttgggattggatgatacagcttttgcttctgtgtagtatacctgnacatacttgtttcaggcagcctttctttaatgttttcagttggnttgtattctgtagctcagtagctgctaataaagtnaaagatcctga

SEQ ID NO: 25677 - DNA, 491 bp, Homo sapiens
  misc_feature 2, 20: n = A,T,C or G
tngaccgggattccaaaagnaactgaaatgaagtctttttagactcagtaggagccttatattcttgaagtcaatactgtaacctcatttctaaggtatacagggttgattctttttctcttaaatcatatgtaacttgcagaagattcagagtcctcagacctctagttcttggaattcctgtaggtttacggtgtatgtgattgtcaagaattaatgacaaaaatgtgtcactgcctacagttctgtgaacactcagaatgtattaatgagctgtttttccatagttttactttagcttaccttgaatactccctgtataatcctctaaaaaggtagcatcggcaagaaagatgaatccgttggaaatacagctgagccatacttcacggaatagaacaagtgtgttctgtgctggagctcaagacctgtggaaagggactgcccaccacacctggcctgaagacttgtaaatgctgccaaattcaaga

SEQ ID NO: 25678 - DNA, 371 bp, Homo sapiens
  misc_feature 9, 27, 30, 34, 57: n = A,T,C or G
gacccgggnggtccgcccaaatccggnagnaagnatgatggaaatcatgacccgagnaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttat

SEQ ID NO: 25679 - DNA, 184 bp, Homo sapiens
  misc_feature 128, 161, 175, 178: n = A,T,C or G
gaaaggcacaggtttggaaaagacctgggaaaaccttaagtttacattttccaggctgatcattggcacaaagacaataccaattcaagacaaaaaacaataaataggaaataaacaaccaaaacccngcaaaccctgaggaaagaggagaatctgatttnccggagtaaccctnttnttagat

SEQ ID NO: 25680 - DNA, 267 bp, Homo sapiens
  misc_feature 265, 267: n = A,T,C or G
atagccgggggttccacaaaaccacttttttttaccccaagtattaaactttaaagtacgatgatgaattttccaaccgatttcagggtccaaagaaaatagagctaagatactgatgacagtgtgagtgatagcatggtaatgaaggacagtgaggctactgcttataaatcattttctttcttttcttccccaaagtcagaattgctcaaagaaaattatttattgttatagataaaacttgagtgataaaaagctatacccnan

SEQ ID NO: 25681 - DNA, 448 bp, Homo sapiens
aactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaaatttttcccagtatttttatacggaaaaaattgtatttgaaaacacttagtatgcagttgataaga

SEQ ID NO: 25682 - DNA, 400 bp, Homo sapiens
attgcatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttg

SEQ ID NO: 25683 - DNA, 441 bp, Homo sapiens
aacataaaagcctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaattttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgg

SEQ ID NO: 25684 - DNA, 309 bp, Homo sapiens
  misc_feature 24: n = A,T,C or G
agaagtggaaaactggaagacagnaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtttagaagatagaaaaatataaagct

SEQ ID NO: 25685 - DNA, 376 bp, Homo sapiens
  misc_feature 4: n = A,T,C or G
tatngcccgggatatttaatcctttcaaaataagataaaaacattttatatgctaacagaatatatttgttacaagttaaagtccagaagtatacacaagattgattactcctattattttttttaaatcacagaaaaatattgatttcattgtctccaaagtgataaaatcatgtattactcatttttgcacttaaaatttttcttatttattccaaggtggtttgaaggtccaagtatgaaaataaattagggggattaatgtataacagttataaagtatcatgttgtattaaagagcttacttagattgatgtttttaaaatgtatcctgatgaatgtctcaagaatgcatctgtcaagttttttagactga

SEQ ID NO: 25686 - DNA, 391 bp, Homo sapiens
atatttgaaaaagtggatttcttgagtctgttgtagtttagtacttacagcagtgcctaaaacagcaactaatatgaactgcctgagtcctacaacataaatgcataaagcttttttatgtaaaagccacaggaggggttcaaaattgaacttttccaaagtttatttctcttgcgttagatgaaaaactatttaaaaggactgaaaaccctgagctttttgctcgtcttggtagcagatatctgtaaaaacctacccagaattgtgattttacttcattgttcttgcatccttgaggctacagtataaatcatctccaaacttgactactattgggaagatgtgtataaaagcatcgctttgggaaattttttaaaaaatatgcaaaaat

SEQ ID NO: 25687 - DNA, 260 bp, Homo sapiens
cttctctcaagaaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaagggagaagagatcattttttaaga

SEQ ID NO: 25688 - DNA, 412 bp, Homo sapiens
  misc_feature 410: n = A,T,C or G
gatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatggtttgntg

SEQ ID NO: 25689 - DNA, 394 bp, Homo sapiens
gtcgaaggaggagcaaggggcttcttggtctatagactattgctaatgtgtctctggacataaatcttctttggttttcattatctattctggagaaagcaatggtgactctgagtaagtggggcagcaattcaggtctttaccacaccacatgcagcatttgtacaggagtagctttggcctcccagaccttagtgacctgggcaggccacccatctctgccttttcttggagtgatttttacaggcacagagtaaactcctgccctcaaatacctactgccatttgcttcctgatgcttaacattccacatttatagaaaaggcctcaaatataaggaccacaataataacacgtgatttaaattcacatagagatgtattggctcctattg

SEQ ID NO: 25690 - DNA, 484 bp, Homo sapiens
  misc_feature 34, 72: n = A,T,C or G
cctcccaaagtgctgggattacaggcatgagccnccgtgcctggcctggagttttgtaaatttgcttaagcntgcccttgatgaagcaacaaaaattattagtttactaaatctcaacctgtggacatatgtctttttcaatattttatgacaaaatgggaagtatacataaaacactgctgcaaaccaaaatacagtggtcatcccaagaaaatcttctgagattgttttaagatgcaagctgaactacctactttttgaaagaatgatggacacagaaattaaggtcattcagactggggtgttgagcagacattttctctcaaatgaacaaaatgaggctaccatttcaaggaacacaaccgacagtacttattgtcaaccatattcaagagaaaaattacaattttgagaaagctgtgtcgactatgaacttgacagctacttaaaaacttttatgatgaaattgctgatgacattgatg

SEQ ID NO: 25691 - DNA, 108 bp, Homo sapiens
  misc_feature 11: n = A,T,C or G
gcggggggcangccttgaggcagccagcgcaggggcttctgctgagggggcaggcggagcttgaggaaaccgcagaataagtttttttctctttgaaagatagagatt

SEQ ID NO: 25692 - DNA, 491 bp, Homo sapiens
  misc_feature 2: n = A,T,C or G
anctccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttgggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtcttt

SEQ ID NO: 25693 - DNA, 256 bp, Homo sapiens
accggggagttgtggagtggccgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttg

SEQ ID NO: 25694 - DNA, 321 bp, Homo sapiens
acccattacaagtttaatacattttgagctttcctaattttttaccttgaagcatattgcatattctgggatgagtgtatgccccaaaaatatttttattggtattattaaagatttgaaggaggaaatattctctttcctatgataatctgaacaaaaaaccttctattcaaaataaatcttgcatagactatttttaattattatcttgaggacaaagaaagattttcccacatagtcctgtgtgtgtatgcgtatgtgtatgtgtgtgtgtacatatgtgtaccatgtgtgcatgtgtgtgttttgatagttatatta

SEQ ID NO: 25695 - DNA, 109 bp, Homo sapiens
  misc_feature 25, 60, 96: n = A,T,C or G
gccgcacctatggcgggggataccnaaagctagctttcttatgttttcctttaaattttnagatttaccttcattctgttttcactgatgtctttngcaagcctttgat

SEQ ID NO: 25696 - DNA, 175 bp, Homo sapiens
  misc_feature 8: n = A,T,C or G
caaaagcnagtggactgtcttttggattcaaagtgggcaaaggccaagaaaaggagaggaagctttatttacaaccagggagtctgtggttgactactgcaacaggcttttaaagaagcagttttttcaccgagccctaaaagtaatgaaaatgaaatatgataaagacataagg

SEQ ID NO: 25697 - DNA, 126 bp, Homo sapiens
ccttattggcccggggtacaaacttagtaagaaaattggaagatagaaacaagatagaaaatgaaaatattgtcaagagtttcagatagaaaatgaaaaacaagctaagacaagtattggagaagt

SEQ ID NO: 25698 - DNA, 377 bp, Homo sapiens
  misc_feature 2, 16, 28: n = A,T,C or G
tntggcggggataggnaatcgtgtttgnagggagatttctgatgccctctgtgggtgtgtgtaagttaaagtggccacatttaagaaggccaagctttgtagtggttgcacaagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaatttaatacctccttagctaagttttattattcaggcaataaacatgttttcatg

SEQ ID NO: 25699 - DNA, 362 bp, Homo sapiens
tggcccgggatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgactttttaataataaaaagaaaagtgaagagt

SEQ ID NO: 25700 - DNA, 478 bp, Homo sapiens
gcggggattataaagattgaaaaggcaagtgtgaagtactcagcccatagtgagcaaccagtatatgttaactatacgataagtatttctttactcaccaaattttgaaataaaccattacctgaggtggttggtaatggtgaaattataatggaagagagctgggcacagtggctcatgcctgtaatcccagcactttgggaggccaagccaggtagattgttttagcccaggagttcaagaccagctggggcaacatggtgaaacagcatatctacaaaaaatacaaaaattagccaggcatggtgagatgtgcccatagtctcaactaatagggaggctgaggtgggaagatctcttgaacccgggaggttgaggctgctgtgagccgtgatcgcaccactatactccagcctgggcatcagagtgagactctgtctcaggaaaaaacaaacaaacaaacaaataaaacaattat

SEQ ID NO: 25701 - DNA, 485 bp, Homo sapiens
  misc_feature 453: n = A,T,C or G
agaactccaaatgcacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgaggggttttcatagctcttggaaatacttttggtctctgaactgtaattagcaagaagtaaaaacagaaacgtcaaacgtcaaatgtttgcttttgttaccttggaggactaaatggnaagatgtctttagtatactttggatggttctt

SEQ ID NO: 25702 - DNA, 380 bp, Homo sapiens
aggaaggaagttgagagaacggagcggacgccatggcgaccagcatcgagcagatttttaggtctttcgtggtcagtaaattccgggaaattcaacaggagccttccagtggaaggaatgaaggccagctgaacggtgaaacaaatacacccattgaaggaaaccaggcgggtgatgcagctgcctctgccaggagtctaccaaatgaagaaatagtgcagaagataggaggaagtacttttctggggtcttagatacagaactacgatataagccagacttgaaagagggctccagaaaaagtagatgcgtatctgtacaaacagatcctactgatgaaattcccactaaaaagtcaaagaagcataaaaagcgcaaga

SEQ ID NO: 25703 - DNA, 145 bp, Homo sapiens
atcaggcctcaggaaaatgatggaatatgctggatgtgatgaccaccaagccatatgctgctgcgtattgaatcagaattccaacagccttttttatctgccattgttttacatagtctggagagagttacagatattatttagg

SEQ ID NO: 25704 - DNA, 319 bp, Homo sapiens
aatagccgggatcgattctttggcaatggattcagcaaatggtggctttgtagaatgatcagttaactgcagggatcagtcgtcagacggagctaaaaagtcccatgctcggggagcctcaccggagttccaggaaaatgttaagaagaagaataacaacttaagcttctacacgtcctaaccctgcaccaaatgctttaggtacggtgttattcatttaaatcccagaacatgcaacagcaggtttcatcagatatattttatccagggggtatataaggctcagagaataaaaaggatatccaaggtcaccaggttg

SEQ ID NO: 25705 - DNA, 177 bp, Homo sapiens
gtgaaacccagtctctactaaaaatacacaaattagctgagtgtggtggcgcatgcctgtaatcccagctactcggaaggctgaggcacaacaatcgcttgaacccaggaggcggagattgcagtgagccgagattgtgccattgcactccagcctggtgacaaagggagactccat

SEQ ID NO: 25706 - DNA, 229 bp, Homo sapiens
  misc_feature 1: n = A,T,C or G
nggcccggggaagactggaaaaagaaatgttggagcagacattacagaaggtcattgagttggaaaatcggctgaaatcttttgagaaaaggtcgagaaaattaaaagaagggaataaaaaattaatgaaagaaaatgattttctgaaatccctcttaaaacagcaacaagaagatacagagaccagagaaaaagagctagaacagataataaaggggagtaaagatgc

SEQ ID NO: 25707 - DNA, 311 bp, Homo sapiens
  misc_feature 30, 205, 260, 283, 295, 310: n = A,T,C or G
ctccccacaaaaaaaacaacaaatcacagnataaggtctgtagtttcaaaacagactaagacagacctttcttagcaatgttatataataaatgaattctggctaagtaagttaattcatatttatactatattgtatttaatgtatttataagtactctttaaatacaattctttggaagataatgccttaaattaaggctgtncctctctctatttctggtaaaactagcactgtattgctggccagtggaggaggtntatattactataggagaaaggcnagagatcaggcnacccatgaggatatna

SEQ ID NO: 25708 - DNA, 303 bp, Homo sapiens
gaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtgggagtttgataatctgtatttggatatgaaatggaatcatccatccctgtactcatcctgaagacaaaccagcccc

SEQ ID NO: 25709 - DNA, 260 bp, Homo sapiens
  misc_feature 9, 11, 41, 166: n = A,T,C or G
attcaaagnanaagtgcaccattgttccccagctccagaanatagagacttgcctagggggagaagtatgctgtaagacagagttctaaatccctttctaaagcaactaacttcatttgctggggagaagttcaggcctaagagtattcaaaaacaggagggtgcnggtgagagacagttaggaggagattggtaggtgcagtggagataaataaactgtagaagggctagtttgctggagagaaccagggaaatgaaga

SEQ ID NO: 25710 - DNA, 352 bp, Homo sapiens
atattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagcgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaat

SEQ ID NO: 25711 - DNA, 351 bp, Homo sapiens
attatttctggatgctaagtccattcagtccaccatctccagctcgcagaaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaaga

SEQ ID NO: 25712 - DNA, 285 bp, Homo sapiens
  misc_feature 5, 6: n = A,T,C or G
atatnnggtcctagtgatgcttctggacgagccctcaaaacaaaaggttgttcattctttgaaggtgatttagcacctaattgtaattcagcagtacgtgaagattagagttgttctatctacagcagtacaacagtgctttttttaaaaataagaaataaattaactgaacaactgtgcttcgtaattcttggacttaggtaagtgacatataaccaaataagagttgtgtataaaaccaagatgatagcccatgaaaacccaaagggatcttttagggtgaga

SEQ ID NO: 25713 - DNA, 430 bp, Homo sapiens
accctcttctgccctcatttcatgtgacagccattgtgagactgatgcacaaactgtcacttggttaatttaagcacttctgttttcgtgaatttgcttgtttgtttcttcatgcctttacttactttgtcccatgctactgattggcacgtggcccccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatgggggg

SEQ ID NO: 25714 - DNA, 312 bp, Homo sapiens
agaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttga

SEQ ID NO: 25715 - DNA, 364 bp, Homo sapiens
atatttgaattagtaactgtatgaagtcataaataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttaggagaaatgatttccacctttatgttttaatatcctaggcatctgctgtaataatattttag

SEQ ID NO: 25716 - DNA, 298 bp, Homo sapiens
gcacacccgtctatgtagcaaaatagtgggaagatttataggtagaggcgacaaacctaccgagcctggtgatagctggttgtccaagatagagtcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgttcaagctcaacacccactacctaaaaaatccct

SEQ ID NO: 25717 - DNA, 380 bp, Homo sapiens
  misc_feature 20: n = A,T,C or G
atattagaaaaaccccaagnaggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtaaccataatgagcaaattgactaagagaagcaaaggtttcttggggttattaaccagtagtgtgg

SEQ ID NO: 25718 - DNA, 459 bp, Homo sapiens
tcaatagaccgggatgttaaaaacatatagcaaaaatctgaagaaaatgtgctaagctataaaagagataacttctggggaaggaagtagagtggaaggatgatgaacctagtggggacccagaggagacactgtatctctgtccaaagaaattgctatgattacacgtttgtcccctccaaaactcatgctgaaacttggtccccagtgtagcagtgttaggagatgggctgatgagaggtgattgaatcatggagctctcatgaatgttttattgtcattattgagggagtgggatgttgtaaagggagccaagcccattgtgctttccctctttagtactcactcccttgctcttctgcgatggaatgacacagcacaaaggtcctcaccatatgccaacccctcaaccttggatttcccagcatccagaaccatgaactattctttataaattac

SEQ ID NO: 25719 - DNA, 498 bp, Homo sapiens
aatagccgggtatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctc

SEQ ID NO: 25720 - DNA, 426 bp, Homo sapiens
  misc_feature 104, 107, 110, 151, 269, 275, 332, 369: n = A,T,C or G
gaggcattgaggcagcccagcgcaggggcttctgctgagggggcaggcggagcttgaggaaaccgcagataagtttttttctctttgaaagatagagattaatncanctncttaaaaaatatagtcaataggttactaagatattgcttancgttaagtttttaacgtaattttaatagcttaagattttaagagaaaatatgaagacttagaagagtaccatgaggaaggaaaagataaaaggtttctaaaacatgacggaggttganatgaancttcttcatggagtaaaaaatgtatttaaaagaaaattgagagaaaggactacaganccccgaattaataccaatagaagggcaatgcttttanattaaaatgaaggtgacttaaacagcttaaagtttagtttaaaagttgtaggtgatt

SEQ ID NO: 25721 - DNA, 366 bp, Homo sapiens
  misc_feature 6, 14: n = A,T,C or G
catagnacctcganagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgaga

SEQ ID NO: 25722 - DNA, 210 bp, Homo sapiens
  misc_feature 4, 25, 39, 43, 48: n = A,T,C or G
caanacgctgaaggctgatgcaccnacttgctgtcgtcngcancctgntgcctgtgtgcatcctatcatgacagattattgcttagtcatagcttgctttggctggaagtaagcgttactgtaccaccaatgttttgaggcagaggaggctcggaggtgatgctgaaccagaattacatgctcctgaaccgggtacctctttaacagtgt

SEQ ID NO: 25723 - DNA, 384 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgaga

SEQ ID NO: 25724 - DNA, 314 bp, Homo sapiens
agaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaagggttgtgattgctgtggggaaaaatcacaacctcaggaaaagtcactcattgggttaaagaatacagaaaataatgacgtagagattagtgaaacaaaaaagg

SEQ ID NO: 25725 - DNA, 320 bp, Homo sapiens
gagggcgaaggtaccgaagccagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaagg

SEQ ID NO: 25726 - DNA, 213 bp, Homo sapiens
  misc_feature 10, 211, 212: n = A,T,C or G
cacatccagnatgtcctgttactggagggcaccatagtttatcctgcacctaacactaatacacctactctgggaattcttctacctacaactatttatttatctgatcccatctggtattaaagttctaaaagttaacagaattcttaaaggttcccaatgcctcccagaaaccccatcatctcaaaatcactagctattaaaagaagcnna

SEQ ID NO: 25727 - DNA, 215 bp, Homo sapiens
gacaaccttagccaaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacct

SEQ ID NO: 25728 - DNA, 333 bp, Homo sapiens
  misc_feature 16, 28, 31: n = A,T,C or G
gaccggggtctcaatncttaaatttagnagnaccagttgtttttatgatatcagccatttgattttttttcttttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaat

SEQ ID NO: 25729 - DNA, 187 bp, Homo sapiens
gaccgggggttcttcacgattctcctggaacccagtctagcaaaatgagaggaaaggccctagggagatttatttctgttaaatagttaactctgctgagtatgacaaatagtgtctactacctcaaccctccaaaatttgcagagtgttgggactgtcatttgtgattttttttttttttgggggg

SEQ ID NO: 25730 - DNA, 387 bp, Homo sapiens
  misc_feature 11: n = A,T,C or G
ctggccggganagtatgttatacatttgttaacatgttttactcttttcatagcctttacacatattttcagttgatctcatccctcctaggagctgtgtcagagatggggttttcctcttttgtagatgagggaacacagtgtcagaggttttgtaatttgtttgaacaagaatggacaaggacctcaacacaggtgttctagctcctaatccacttgtcctgccacagccccattgctgtcagttcttcattactttcctgatgtgctggagaatctgaaatttgtttttactttgtgagttctgtggttatgtcataaattctgctggcatatggcagtgttagccttgttttcaaatatcttttgaattctcagaaaaagcct

SEQ ID NO: 25731 - DNA, 421 bp, Homo sapiens
  misc_feature 2, 15: n = A,T,C or G
gnaataattcacagnctaaagctattatgaatactctctcaatactcctaaaatctaggagaaggtaaggatatccatattgaccactttcatccatcaatgtagtggaggtcttatatacagagagaaagagaaggcaggagaaaaagaggaaggaaaaggaaattaagaagtataactgcctttattagaagatgttatgctcctgtatgtgaaaataccaagaattacacatacacgtgcatacacacacatacacatgcacacacatacacatgcatacacattcacacacacaactatggaggctaataaagattaataccagatacatatacaaaaatacacatttttgtagtatacaatggataatacaaatgaaattaagaaaataatttcatttagaatagcttcaaaaaga

SEQ ID NO: 25732 - DNA, 433 bp, Homo sapiens
  misc_feature 26: n = A,T,C or G
agggagagagatgtactttttaaatntgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagctttagattttcctattgtgacagagccatggtgtgtttgtaataataaaaccaaagaaacat

SEQ ID NO: 25733 - DNA, 318 bp, Homo sapiens
gagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttagacgggatctcgctttgttgcccaggctggtctcgatctggcttcaagtgatcctcccactttggccttccaaaatgttgcgattataggcgtgagccactgtggctggcctgaaattttctagtatccacattcataaag

SEQ ID NO: 25734 - DNA, 396 bp, Homo sapiens
atcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaatcgaagttaacattcttattttcaagagaatttatggacgttgtagaaatgtacaaatgcatttccaaactgccttaaacgttgtatttttatagacatgttttttaaaaatcctaagtttttaaataactatggatttg

SEQ ID NO: 25735 - DNA, 193 bp, Homo sapiens
  misc_feature 7, 190, 193: n = A,T,C or G
gaaaganttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacaccaaaatgttgccngtn

SEQ ID NO: 25736 - DNA, 420 bp, Homo sapiens
  misc_feature 3, 14: n = A,T,C or G
acngggccgggganggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttt

SEQ ID NO: 25737 - DNA, 333 bp, Homo sapiens
  misc_feature 6, 8: n = A,T,C or G
cccccncnggaccggggcagtagaagttttgtgtgtattttgatggtggttttaagtgtgcaggctggggggcggccccagaaaatctaacatctcatatgtaaatcttaagcaactcatgttaaatgggcagcaaatttatggatctatatcaatgtgttaaaatgtttcaagtccataagcagtgaaataactaatagtaatggatctcaaaggaaaaaagaggcagaactagaaacatcaaatgtataagaattattttaaataactggttgctcatcttggttctctgagccaagatgagcaaacaattcccagactttttttttttga

SEQ ID NO: 25738 - DNA, 441 bp, Homo sapiens
gaccggggaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcaga

SEQ ID NO: 25739 - DNA, 471 bp, Homo sapiens
  misc_feature 11: n = A,T,C or G
aactgactttnacgaagtcaacaaaaataaacaatgaggagaggataccttttattcaatgaatggtcctgggaaaactggctaatcatatgcggaagaatgaaactggaccactacctctcaccatatacaaaatttaactcaagatgggctaaagactaaaatggaagacctgaaattccaaaaattctgtaagacaacctaagaaaatctctcttagtcattgtcctagacaaagaattcatgactaagaccttacaggcaaatgcaacaaaaccaaaaattgacaatggacctaatgaaactaaagagcttctgcacagcaaaagaaactatcaacagagtaaacagacaacctatagaatgggagaaaatatttgcaaattcttttctgttttcttaatgctctggtattttttggcctttctgactgaagagagactgctttttccaggcctagccaattattag

SEQ ID NO: 25740 - DNA, 260 bp, Homo sapiens
  misc_feature 4, 9: n = A,T,C or G
gcgnccccnaccggccggggagcacactaagtgagtcaggagtgggtggaagaatctctccagtgattgaatgacctgacttgaaacatgagtcagacacatctgttatttaatcagcactgccactacctgggtttgtcaccttgaagatatttgtcacttattttgacctcagttttttagctgtaaattgcattatattagtagggcttgaaaggtagaaaaatatttacaaaggtcatgaaagaggtgggtttcag

SEQ ID NO: 25741 - DNA, 245 bp, Homo sapiens
  misc_feature 2, 245: n = A,T,C or G
cnccttcagtatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatggtggatgttttacccacatgacttattatgcataaagccaaatttccagtttaagtaattgcctacaataaaaagaaattttgcctgccn

SEQ ID NO: 25742 - DNA, 246 bp, Homo sapiens
  misc_feature 10, 15, 26, 27: n = A,T,C or G
cggcactgtntggcncgggcacgatnnaaaagggacaagcatcaagcacgcaacaatgcagctcaaaacgcttagcctagccacacccccacgggaaacagcagtgattaacctttagcaataaacgaaagtttaactaagccatactaaccccagggttggtcaatttcgtgccagccaccgcggtcacacgattaacccaagtcaatagaagccggcgtaaagagtgttttagatcaccccctc

SEQ ID NO: 25743 - DNA, 313 bp, Homo sapiens
  misc_feature 1, 15, 26, 29, 31, 40, 269: n = A,T,C or G
nagaagggggggagngggggaaaaangancnggggagttnaaatgattctcctgcctcagcttcctgagtagctgggatttgcaggcattgtgtcaccacgacctgtttaatttttgtacttttagtagagacggggtttcaccattttggccaggctggttttgaactcctgacctcaaatgatccgtccgcctcctaaagtgctgggattgcgggctttagccactcacctggcccacacagctgtttttagattggtatacgaagnagagtgaatttttattgtgcataaaaggtggaaaaatgaacagg

SEQ ID NO: 25744 - DNA, 322 bp, Homo sapiens
  misc_feature 81, 190: n = A,T,C or G
gaagatgataaagatgattgaagatactacagatctgcagccaaatgggtttcctaattatacttctcagtgacagttaangcgacagcatggctgaatagtgacatggttgcacctctccctctcagagtcgaggctgcatttattaattggaagggaaattgtcttgacatttttttttgaaaggtanaaatttcttctaatttcactaattgtattagcccttgtaagattgaaggaaaaggatttcagagtatttcccaatactttgtcaagggaggatattgcagctttataggctaaggtaggagcccttggaagg

SEQ ID NO: 25745 - DNA, 344 bp, Homo sapiens
cttcagtgtgttgataaaggagagccggatgaaaggatcaagtcacctaagcctaacctgtaatatggcaactgcacaagtccccttggcaattttcaagagcaagtgctgctgaggccagtgcctccttggttgctgcattccttcctgctatcactccttgtccccactagccactcagaggtcaagtggggcaccttcaaaagggaaacaactgcccacaaggccagtgcaaatggagctcacccccagatgtttttagtaacaatttgtaaagtcaaaacaacagggtgccaaacccaaggtcatctagattttctcctgttatcttctaggagttttat

SEQ ID NO: 25746 - DNA, 485 bp, Homo sapiens
  misc_feature 3, 4: n = A,T,C or G
acnnacaaaagtacccttggctacaaccactactaatgtcccttcctcttctgcctcaaagttaggaaagaaatataaacactgagattgccccagagctgcagtgggcagcctaggagtgccaagccatgacctacagccagcactcaagggggagagaagcacattttcagatcattgagagggaacatggctgcaactgtaaggaaacataggggagccacatgaccaagcaagagtctaccaactgaccagtaagcccaagtgccacctactggatcacatcccaaagcttcagcatcaaaaataccttactaatatactcccctctgaaaccagaaatgagaagtcagcttcaaataaagaccctgcacaaagcctcagcctggtgaaaacatccgaaaataggtctacggactgtactcaatctacactgcaattaaaggaaaacccataggtggaaatgagaagaaaccaatgcaaga

SEQ ID NO: 25747 - DNA, 317 bp, Homo sapiens
caacttagagtggggagcagagaattctcttatccacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaac

SEQ ID NO: 25748 - DNA, 354 bp, Homo sapiens
  misc_feature 9: n = A,T,C or G
gaccggggnagtcctcgaaggctcggaagcccgtcaccaggtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagaga

SEQ ID NO: 25749 - DNA, 422 bp, Homo sapiens
  misc_feature 7, 13: n = A,T,C or G
tctggcncggggnaggcattgaggccagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttt

SEQ ID NO: 25750 - DNA, 467 bp, Homo sapiens
  misc_feature 10, 12, 34: n = A,T,C or G
gcggaggatntnttagttgctgtaacattgagangtgaaatttggaggattcgaaataaatgcagctaaatggaacttttggatgaagaatccctggtttgttcagatctgttaaagtaataggggaaagcacaaaaggatcaagaaaaggaaggccccaatctttgttcgatgactgataaaacagcattacttgggtgaaaattggcctgaccttcacctacaggatgcttccgctgcctcagtgattcttgcttcgctctgattagactctcctctaaagctctgctgggagaggacggccggagaaagacacaagtctccctcagctggctggaacagaaacatcactgagttacaccaggtcctatttgccatccatttcttctttttgccacaaatagagcatcaaaatagattgttcatttagaaggaacacgtccaagctattgccaaccctatgttgg

SEQ ID NO: 25751 - DNA, 410 bp, Homo sapiens
  misc_feature 3, 4: n = A,T,C or G
canncactggccgggatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatatttt

SEQ ID NO: 25752 - DNA, 209 bp, Homo sapiens
  misc_feature 11, 14, 27, 42, 44, 51, 58, 78: n = A,T,C or G
acaccccccgngancccccgccccccnccgggcccgggaaanancaaaacnttgaaantctggttaggctggtgttanggttctttgtttttggggtttggcagagatgtgtttaagtgctgtagccagaagcggggggagggggggtttggtggaaattttttgttatgatgtctgtgtggaaagcggctgtgcagacattcaattgc

SEQ ID NO: 25753 - DNA, 100 bp, Homo sapiens
  misc_feature 6, 13, 49, 67, 71, 82: n = A,T,C or G
tctgantggcttnttgttgaaactgttagactaaactgtggagcactgngctggactaaacgcggtnttgnatcctctgcangcatgctatatctgcttg

SEQ ID NO: 25754 - DNA, 423 bp, Homo sapiens
  misc_feature 194, 228, 251, 258, 277, 299, 308, 341, 388: n = A,T,C or G
aaatgcaaaaaaaaaatctgacaaaatccaacagcttttcattatgaaaaacactcagcctactcggaatagaaggcaacttcctcagactgatgaggagcatgtgtaataaacccacacctgaaaataagggcatctagattggagagaagtcaacttacctctttttgcagatgacatgattttagatgtanaaaatcttgaggaattgacaaacaaatctgttanaactaatgagtcctggaaggatncaggatncaagaatgatttgcaaatntcaatttttgtttttatacagnggcattgtncaagccaaaaatgaaattaacaaaacaactctntatagcaccaaaaaatatacaatacttaaatgtaaattttaaacaanaaatgcaatacttgaacactgaaaactataaaatg

SEQ ID NO: 25755 - DNA, 453 bp, Homo sapiens
taataggccgggcttctcgctcatcatttattaatctttcccatgcaagtcatacgtgaatatatccttgtggtaaagttttcaggtgatagcgaaaactcagtctcctgtcaccgtcttctctcctcatctaggtgcgcgctataactaagtcctttgcctcttccagagtttttttctccctgtgtaccattggccctctgcacttgtgggttttgcatcctcgtgttcagtcacatagggtctcaaggggaaaatattcaagaaaaaatatccaataaaaactaatacagcaatttaaaaaatacaaattttggccagacacaatgccttatgcctctaatcctagcactttgggaggctgagacaggggaatcacttgagcccaggagtttgagaccagcctgggcaacatagggagacgtctctgcaaaaaatttgaaaattagccgg

SEQ ID NO: 25756 - DNA, 381 bp, Homo sapiens
cattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcgtagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataaga

SEQ ID NO: 25757 - DNA, 100 bp, Homo sapiens
  misc_feature 2, 3: n = A,T,C or G
gnncgggcattctggaaacttttgttagggctgcttttcttaagtgcccacatttgatggagggtggaaataatttgaatgtatttgatttataagtttt

SEQ ID NO: 25758 - DNA, 290 bp, Homo sapiens
cacacgaaatggagcaggcttcaaactcaaaagtagctgaagaatacttacaatggaaatgaaagtgaccctagagcatcaatctgtaagtttatccacacacacaaaaagagggtttgtaagagttaaatgtaactggctgaagcttatagctggtgtttgttacaaagtacccaagcttttcctttccaacttcgtggctttgaagaattataggaattttatgatgtgctgttggagttatactggcagagattacagtaaaggggttaaagttggtttatggtaga

SEQ ID NO: 25759 - DNA, 370 bp, Homo sapiens
  misc_feature 6, 34, 41: n = A,T,C or G
gtgcgncccttatggaccggggccaggccgaaantcagggnactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagaaaatg

SEQ ID NO: 25760 - DNA, 472 bp, Homo sapiens
aagcggcgagggtagccatgacggcctccgtgctgcgaagtatctcgccagccctgcgcccgactagcgggcttctgggaacttggcagacgcagcttagagagactcaccagcgagcgtcattgttgtctttctgggaactcattcccatgagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaagagagcggcctcaggtggagcctcacctttgaggagactgagaggagagctctgcttctgaagaaagtggtccttgtacaagcagcaagagcataagatgggagagggacaccatcagggctatgcttagaagcccagcaggaagctctggaggaactgc

SEQ ID NO: 25761 - DNA, 481 bp, Homo sapiens
gtgtcattggaatactggaggagagcaaaggtgtaacacttgtgtcattaaagtcctgaaaggagattaataaggaaaaagaaggcaggcacaaagaaataatggatgaaaatgttccaaattagcaaaaggcataaacctacagatctgagtagctgagcaaaccccaaacacaataagccaaaataaatcaggaatggccatattagtgtcagataaagaagactttagagcaaagaaaattaccagagacagagagggctgttacattgtaataaaagtgtcaaacaaccgagaagacaacaatcctaaatgtgtatgcagaaaataacacagctgccaaaatacatgaaggaaaaactgtcataactaaaaggaaaaagacaaatctacaattacagttgcagacttcagcacgcctccctctcttactgataggtagaacaactagacagaaatagcaaagaggtagaactcagca

SEQ ID NO: 25762 - DNA, 426 bp, Homo sapiens
  misc_feature 3, 5: n = A,T,C or G
atngnccggggtagttgaaggagttgcatttatctttctggctcctaattcctttaaaattacatttgttgcagaacctccacaaggctaaataaaattacatttgtgaccatcagagaactgaataaaccattaactggccatcctggttttgcagagatcaggttgttgacagttcctggttgacccacagctacccatgtcagttatctccactaacatatccaagaatctttgtaggacaatttctccacctgcaaggtctttcgggtagaactcttcttttaaggcaattagcccattgccaaaaggttttactgtcttaaagctgtctttctgagatctaattccaaggacttctccacagctaagtgagatgcctcacaccattaggtgatgctttggacagaacagaagtattttcat

SEQ ID NO: 25763 - DNA, 163 bp, Homo sapiens
caacaaaaaaagaagaagaagaagaagaggaagaggaaagaaagagagagagagaaagaaagagagaaagagagagaaaagaaagaaagagaaaagaaaagaaaagaaaaaagaaaagaaagaggaaggatggaaggaagggaggaagggaagggaaggaagg

SEQ ID NO: 25764 - DNA, 313 bp, Homo sapiens
  misc_feature 3, 5: n = A,T,C or G
aantnaagtgtccccttctgcatgggatgacaagaatcatttaatgctttctggggaaaataatggagtttcctatgggaaaaatgtgtagagagataatattgaaagagatgggaaatacagaacagagttcagggagattaaggcagctggaatatgcagaaccagtaataaagaggaaaaagagaatgccaggtgcagcggctcacacctgtaatccaagctactttgggaggcacaggccagcagattgtttgaggccaggagtttaagaccagcctgagcaacaaagtgagatgccatcactaccgct

SEQ ID NO: 25765 - DNA, 382 bp, Homo sapiens
taatgattccccatgtttttaggtgtaatcatccatccattcattcagcaaatgtttattgaatgcttaccccatgtattttagtaactagagcggcaggaggacgttggggaatgtaataaagatatatagtagacaggtcctgctgttgaagagcttacagcccagtaggaaggtaagaagatacacgtgggctgggcgcagtggctcacgcctataatcccaacactttggtaagccaagatgggcagatcacttgagctcaggagtttgagaccagcctggacaacagggcagaaccctgtctctacaaaaaaatacaagaattagctgggcatggtggctcatatttatagtccaagctcttgggggactgaagtgg

SEQ ID NO: 25766 - DNA, 232 bp, Homo sapiens
  misc_feature 10: n = A,T,C or G
cggcacctcnggccggggttcacacaggatccggagctggtgctgataacagcggaatcccccgtctacctctctccttggtcctggaacagcgctactgatcaccaagtagccacaaaatattaataaaccctcagcacttgctcagtagttttgtgaaagtctcaagtaaaagagacacaaacaaaaaattctttttcgtgaagaactccaaaaataaaattctctagag

SEQ ID NO: 25767 - DNA, 464 bp, Homo sapiens
gccctggaagaaggcctgctctaaattatccgtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaatttttgacactgaaaaacattttattaataaaggaatattgac

SEQ ID NO: 25768 - DNA, 336 bp, Homo sapiens
atgacagtaatatttacaaataggtaaaaaaatatagagttgtctggtttagactcctgttgtcatggcatgtttaaagaagaaagcttccagccgagaaaggcttgtgatgaagtagcatcacctttcagttagttctctgtagtatagattatgtgtatgtgtctgcctggtcatagatgctggtagctaggtgtccttgcctgatgccaatatgattctgggctgaatgcatatgaatccattctaatataagtgtaaatagcacatgggaagataaacctaccaagagaaccacatacagatcatatggtttattccagaggcaagaatgat

SEQ ID NO: 25769 - DNA, 318 bp, Homo sapiens
aagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatc

SEQ ID NO: 25770 - DNA, 192 bp, Homo sapiens
gttcagacagaatttgaaaattacttttaagtttgcaccagaatgtaactacctttgatatttaaggggcaaaagcaggtgtagagtttgtaggaaacctttatgttatttaatccctgtaatcatggtaccctcttgagagtttgcatgtttgaaatatttaaatttaactcactcatgatttttttcagc

SEQ ID NO: 25771 - DNA, 367 bp, Homo sapiens
gttaacatttggcatttaaaaataaacacgttttttgaatacttggttttattatttgcataggagtataaaatgaacaaccagaaaggtgctaggttgcatattacacatttgcactttgtaatttcatatttgcagtttgtgctttgatttagaaaacactaataacttcattggaaatgccttgtaatacaaaattatatttcagttgtccttttctagttatttgtagattcgtgtacattctgtatcattataaaagaaatcaagaaagcaatcccatttacaatagtgccaaataaataagataactaagaattaaatttaaccaaacaagtgaaagacccccataaggaagattataaga

SEQ ID NO: 25772 - DNA, 493 bp, Homo sapiens
  misc_feature 9: n = A,T,C or G
gaacggggnagtgtgaaatcttcgcagaagcaatttctctttagttctttgcaaggaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgagggaggttgttttagctctgctaaaaactccagcgcaatttgatgctgatgaacttcgtgctgccatgaagggccttggaactgatgaagatac

SEQ ID NO: 25773 - DNA, 456 bp, Homo sapiens
  misc_feature 9: n = A,T,C or G
cgcaatagnatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactagaaaaaaaccttgtagagagagtaaaaaatttaacacccatagtaggcctaaaagcagccaccaattaagaaagcgttcaagctcaacacccacta

SEQ ID NO: 25774 - DNA, 495 bp, Homo sapiens
  misc_feature 4, 14: n = A,T,C or G
tacntgcggccctnatagaccgggggagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaaaga

SEQ ID NO: 25775 - DNA, 354 bp, Homo sapiens
cactctgtgaaccctgcagaagataattatcaaaatatgttccttgaagtgcccaaagaaagaccttttattcagttcctcgaatctctcccccttgttgactcagatggaagaatgcagtcccagaaaggcgaaagagggaaccaaggacacatttttggtcaaccaaaagaaagccggcattggtgaccacagttgagttagcagttggttaacaggtccgggctattttctacccccaaagggagagctgaaccaagctcaaccccagtggagtcagtggccgtgcttagcaatgtgccaaggcatgcaccctccatcaaacttgctacgtagctctgtgagagcagactt

SEQ ID NO: 25776 - DNA, 278 bp, Homo sapiens
  misc_feature 8, 32, 44, 55, 83, 129, 145, 149, 170, 177, 210, 220, 267: n = A,T,C or G
gtactggngaagaaggaaaatagaaggctgangatccaggtganagcaaatggangagcttttggataagaaaaatagattangctgcataactctcaaagctcctgatttcaagatgtcacaacttgngtctgcgagaaaaaanccancttgttgattccctgactcanatccgtnagctccagaggtctctggatgaaggagaaaganagaaatgaanacttagagactgaactcaggcacttgcagaactgatgattccttcanctgtacgactc

SEQ ID NO: 25777 - DNA, 383 bp, Homo sapiens
ctagttccttgagtgtactcttaggttatttatttaggtcatttttcttttcaatgttagtgtttaatcccataaacttccctcttagacctgattttgctgcatcacataggttttggtatgttgtgtccccatttttatttatcttaaggtaatttttaatttcccttttaatatcttctttgacccattgattgttcaggagcatgttgtttcatttccatgtatttgtgaattttctgaaattcctcctgttattgatttccagttttatgccattgtggttggaaaatatacttgatatgattttaatatcactaaatttgttaagtctgatgttttatttactttttttctgtatgatttgtccattgctgaaagtg

SEQ ID NO: 25778 - DNA, 387 bp, Homo sapiens
aagggcaaatgtctgataaacatatgaaaagatgctctaccttactaatgatcaagtaaagggagaatgaagcaaagcaatgccggttttaccttctcaagtttccaaaattaaagttttaggatgccaagagttggaaagatttgaagcaagaggaacactcaagtgttgctggtaggaattttaattggtatcagtagtttagagattgatttggcatgatatactaaagttgaagatgtgcattccctactctctagcaacttactgctagctacatagcctagaacaatgcttgcatatgtatattgatacataagtagatatatattctttttaaaattgttttttaaaaaagggtcttgctgtgtcatccagactggagtg

SEQ ID NO: 25779 - DNA, 370 bp, Homo sapiens
aaggcattgaggcagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaga

SEQ ID NO: 25780 - DNA, 305 bp, Homo sapiens
aggcattgaggcagccagcgcaggggcttctgctgagggggcaggcggagcttgaggaaaccgcagataagtttttttctctttgaaagatagagattaacacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaac

SEQ ID NO: 25781 - DNA, 461 bp, Homo sapiens
  misc_feature 7, 18, 25, 26, 29, 37: n = A,T,C or G
gcaagangtagtaggtgngtccctnntanaaaggggnagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacaga

SEQ ID NO: 25782 - DNA, 420 bp, Homo sapiens
  misc_feature 12: n = A,T,C or G
atctcagaaacngtcttccccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtggtttttttatttctactgtcaaatgatgtgcaaaaccttttactggttgcatggaaatcagccaagttttataatccttaaatcttaatgttcctcaaagcttggattaaatacat

SEQ ID NO: 25783 - DNA, 167 bp, Homo sapiens
gtatgaatgttaatgttgtcagtgtatgtatgaatatgaaagtgctttgttttgtttgttgctgttttttgtttatgtgtgtgtttttaattttttgttcttatcagcagtcttgtgttagcactgggtaagctttaattgtcccttagccaatcaaacattaagga

SEQ ID NO: 25784 - DNA, 401 bp, Homo sapiens
gaccgggcaccatgttcctttgtatatgatgcagcagcataaatgtaagcttttatatcataagttctggtctttccagtcacatctggaaataaagcgtattattttcttgggaaaacatacttttcatatctcttgccccaaagattgggctgtaagccattttctagcaaatgtctctatgaaggtttctaagtacctgaatggggtttgattctgaaatctttctacctgttgcaccgatattcaaataaaaatgatagacacagaaaggtttggtaactttgggttttgtaaaatcagcaaaggcagtgtttcaaaaagtgcaaaaaaaaagattctgttataaagtgattttctaagtatttcctaactttatttttcaaaatgatgttatgaac

SEQ ID NO: 25785 - DNA, 477 bp, Homo sapiens
  misc_feature 10: n = A,T,C or G
gaccgggggnaggcgtccgcgtcgctagctagtcgttctgaagcggcggccagagaagagtcaagggcacgagcatcgggtagccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcggagaaagtgtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacga

SEQ ID NO: 25786 - DNA, 499 bp, Homo sapiens
  misc_feature 2: n = A,T,C or G
tnggcgctctatggacacgggggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatg

SEQ ID NO: 25787 - DNA, 495 bp, Homo sapiens
  misc_feature 2: n = A,T,C or G
cnggggtttttatatatttctagaaatttttatagcagttgcaggtaaactgtcaggattggttttaaaatatttttgtaactttaaaatattctataattatgcatgtgattttaacatttaatattcaaaaataaatctcttgctggatttgagagtattgcatttttaaagtctctcttctgtaactggatgttttggcaacctttgtggggagagactgctggatttcttaaagcaacgtattcctgacactggccacagaatgcctttggaaatcggatgtactgttctcttgttcacgtttagtggtgttttgctgttttgttttttaaacaaatgatgctgagaataaggagagaaatgaatgtagagagaggtagagagagaaatatgaactctaacaaaggactgaggagtgcagtctgctggttcaggcccttcaaaagatgtagaaaaagagatagaaggaaccacctatgcttaaaatactgt

SEQ ID NO: 25788 - DNA, 324 bp, Homo sapiens
  misc_feature 12, 14, 51: n = A,T,C or G
cattggtgttgncnaagtaccgttttgtgacaggcaataaaattttaaganttcttaagtctaagggaccttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgttt

SEQ ID NO: 25789 - DNA, 259 bp, Homo sapiens
gaagatattgatcacttaattctcaatgtaaagattaaagatgtcatcttatttgtggataatccatgggggcaatagcaagaagtccctttttcaccataaaggaacccaagcgcttgggtaaggttcccatcatggcactgagcccatggtggattagagcagaggtgtagagtgattttaaggagactggattgcttgagcccaggagttcgagaccagcccaagcaacatagcaaggccccatctcaacaacaac

SEQ ID NO: 25790 - DNA, 282 bp, Homo sapiens
agtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttcctgc

SEQ ID NO: 25791 - DNA, 429 bp, Homo sapiens
  misc_feature 3, 10, 47: n = A,T,C or G
acnggagtanttgcggcccttatggaccgggggagcggacaaacggnaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatat

SEQ ID NO: 25792 - DNA, 174 bp, Homo sapiens
  misc_feature 1: n = A,T,C or G
natacataattatatgtcatctgtgtggcaggaaatagtttagcatcctgtggatacaatagtgagaaaaacaggtaacaattcctgccttcctggagcttacattctagtcagggaaacagacaataaccaagataaataagtaaacaataaagtatattaggtagtgataac

SEQ ID NO: 25793 - DNA, 468 bp, Homo sapiens
aactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatgggg

SEQ ID NO: 25794 - DNA, 452 bp, Homo sapiens
gagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgattt

SEQ ID NO: 25795 - DNA, 433 bp, Homo sapiens
  misc_feature 19, 359: n = A,T,C or G
atcaacatgctattttatnatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacgattaaagaatatgcccaaaacatctggaacgtggaacccttcagatctaaagatttctctatccaatgaatctaacaaagtcaatggaaattgaactctagaatgtctctagaaaacatagcttcttactgaacttgaacatttttacaacattcactggtttttgttttgttagctaataatctataataagntggagtatctctgggaatggggagggaaattatatgtaataggagcttaaaaataaagtgtcaatttccaaggc

SEQ ID NO: 25796 - DNA, 332 bp, Homo sapiens
  misc_feature 6, 14, 34, 47, 70, 319, 322, 331: n = A,T,C or G
agtccnagtggcanagagcgagctgagtggttgngtggtcgcgtctnggaaaccggtagcgcttgcagcntggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaanaanaaattacana

SEQ ID NO: 25797 - DNA, 167 bp, Homo sapiens
agttttagtggaaaacatgatagctggtgttactgagtaaatttgagtgttaaatgtcaatgtaagctaacggccaagatagggaccactgcagggtggttacttgcagctatgactcaactggtccttcactgccaaacatacctgggtgacagagactctgtctc

SEQ ID NO: 25798 - DNA, 122 bp, Homo sapiens
  misc_feature 5, 115: n = A,T,C or G
cggcnttatggcctgcaggatccggccgcctcggcccagtcgactctagactcgagcaagcttatgcatgcggccgcaattcgagctcacttggccaattcgccctataggaggntcgtata

SEQ ID NO: 25799 - DNA, 160 bp, Homo sapiens
gactgaagagagggtgagaggtcacggctggggctggagatggggagtcatatgcattcaggtggtaattaaagccatctgatgggagcttccatgaggagtgtgctgtgagggaacaaagcccatggccccaaactgagccttgctggaggaaagaagg

SEQ ID NO: 25800 - DNA, 195 bp, Homo sapiens
ctatggagctgtgatctcctacaaatcaaatggggaatgtctgtggatgtgtaagagctgagaaagaagaacaatatgtagatcctgccaaaactcctttgaaccctgaaaaatactctcctggaagaaaatatttcagaagaaaaccgatcaaaaaaactggaggtgacaaagagtcagttggggcaaacaacg

SEQ ID NO: 25801 - DNA, 479 bp, Homo sapiens
  misc_feature 76, 142: n = A,T,C or G
caggtattctgtaatatggaaactggggaaacatgcataagtgccaatcctttgaatgttccacggaaacactggnggacagattctagtgctgagaagaaacacgtttggtttggagagtccatggatggtggttttcagntttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattg

SEQ ID NO: 25802 - DNA, 388 bp, Homo sapiens
gaacgggggtgtgagctaggatatgatttaaatttaaaatatttctaattacattcctgttgtcataattattgcacttaagctatactgtctctagaagaagcactgagtaaatatataagaaaaattgttagttttggtttattataaacaaattgatgcttctggaaaacctgtgattatatttaaacaaaatattacccttgtcatcatttctgtgttttgctgaaagcctttatttggagataatgtaacaaacctgaggcggaggtatttgtcactatcacaacttccaaattaagtgtaaatgtttgacgttttattatattctctccatattgttacatttaaacattagcactttagcagaaagaagtgttttggttat

SEQ ID NO: 25803 - DNA, 359 bp, Homo sapiens
gcaaaatggcgtgatgaaagcatagttctagggaaattagcctgagaatagcagaaagaatggtacagaagaaaaatagaccaggcacggtggctcacgtctgtaatcccagcactttgagaggtcaaggcgggaggatcacctgaggttgggagttcaagaccagcttgaccaatatggagaaactctgtctctactaaaatacaaaattagctgggtgtggtggtgcatgcctgtaatcccagctactcagaaggctgaggcaggagaatcgcttgagcctgggagccagaggttgcggtgagctgagattgcgccattgcactccaggctgggcaacaagagggaaactccatctc

SEQ ID NO: 25804 - DNA, 295 bp, Homo sapiens
  misc_feature 15: n = A,T,C or G
gaacagctaaaaganccacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaccttgtagagagagtaaaaaatttaacacccatagtaggcctaaaagcagccaccaattaagaaagcgttcaagctcaacacccacta

SEQ ID NO: 25805 - DNA, 475 bp, Homo sapiens
  misc_feature 8: n = A,T,C or G
gaaacagnaaaatctcggaaagaaatagaagatataaagaagaaccaaatggaaattttgaactgagaaatataatattcagtgaatagattcatgagcagaatggtgaagacagacataatgacaagaacagaaattacacaatctgaaaaacatagagaaaacagactgaaagagaaaagaacagagcctgagaacagtgggatataacaagatatctaacattcatatcatcataattttggaaggagaggagactgaaggtgggagtgaaaaagtactcaaagaaataatagctgacaacttgccaaatttggcaaaagacatctacagattcaagaaagctgttcaggataaactccaagaaacctacaccaagatatatcatagtaaactgaaaactaaagacaaaggaaaggcttgaaagcaatgagagagaaattatgcattacctttaaagagaaaaacaatttga

SEQ ID NO: 25806 - DNA, 431 bp, Homo sapiens
  misc_feature 13, 33: n = A,T,C or G
acatcaaaacagnaacctctttaaagctaaatnacacagtacccataatgcaaaaatacaagttaaaaagcaaaaacacaaaacaaaaccaaagtacataggcaagaaagagcactacgaaagtaaagtaacggtacctcacatttcaatactaacattgaatgtaaatgacctaaatgctccacttaaaaggtacagaaccgcagaatgggataagaactcaccaaccatctgctgcctttgggagactcacctaacacataaggactcacataaacttaaagcagtggaaaaaggcatttaatgcaaatggacaccaaaagcgagcaggggtagctcttcttatatcagacaaaacaaactttaaagcaacagtggttaaaagagacaaagagggacagtatataatggggaaaaagggcttttgtccg

SEQ ID NO: 25807 - DNA, 100 bp, Homo sapiens
  misc_feature 2, 3, 35: n = A,T,C or G
cnncccgggtattcggccttatggccggcaatagnacttgtttaatgcagggttgccacaaaccttcaatttgtaaaaagaacagtatctgtaaaatgct

SEQ ID NO: 25808 - DNA, 318 bp, Homo sapiens
  misc_feature 9: n = A,T,C or G
cgcaatagnatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagataagtccaaagaggaacagctctttggacactaggaaaaaaccttgtagagagagt

SEQ ID NO: 25809 - DNA, 470 bp, Homo sapiens
attcaaggagaagataccctttctctcataaaaacacttagaagcaaactaccactattaaatcacctattgcatactgcctcagagccatgtgtccagttattctggtttttatctggtacccacacacacataatacttagtacatttccttatatgtaaataattagtaatgtaacacatcgagtgaatgaaattgtgattagcaaagtatgacagctaaaaacaaaggaaattttgtatagtttaagtttttgtacagcagaaggtaatggaaaatatttgcaacatatgacagtgtttttaatgtcttaagtatatgaagaatttgtttcaattggtaagaaaagaccaactgaaaaataggcaaaacataccaaatttcgattcacaaaaagatacaaatggccaacaaaacatgaaacaccttgaaccccattggttacaaaaaatacaaataaaaacaatgc

SEQ ID NO: 25810 - DNA, 283 bp, Homo sapiens
gtggatatttttaaacaattaaaaattaaaatgaaaaacaattatcttgttcctggtggttctcagaacatatgaatatccaattctaaaaagtaaacacctttagttgtatttctgtgtacaggatgtctcaactctgtatattatttaaaatttagccttttcttttagaaatgcttaattttttatttaaaaataattattttagttagctagggtttttgtattcctttcaagtctgctttctgagccatactccagtgtcatgtggaaaatgttacca

SEQ ID NO: 25811 - DNA, 450 bp, Homo sapiens
  misc_feature 5, 19, 393: n = A,T,C or G
gcgcngggtaattacggcncttatggaccgggattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatattaggtnggaaatagcagtaagctttcccattataatatattttttgtatacaaataaaatttg

SEQ ID NO: 25812 - DNA, 477 bp, Homo sapiens
  misc_feature 14: n = A,T,C or G
gttacatttatgtnatacaaatgttattttattataactaaagttatttgtacctttggacaagcattatattgatagcaatatagcacttaaaggatttctatcaagtacaaaagaaaatagtaacaaacacagaaggtagggtaacaggaagtaaaaccacagacctaagaggcaaagcatttggctttattggtgaacaaaatgtgagacatgaatgcttactaacatttttgacatagtaggtatcctttatttcatgaaaatatccccataacatgttaagaaatgctttagaatcctgagattaaaaaactaataatatagaaagtatgtatctcctatcatatatgtatgacttaaattaaataaccatataagatggagctatttttaaaaatattggttttcacctattattaatgatcattccttgaaatcaagacctgctaagttaaggtatatttaatgccaaac

SEQ ID NO: 25813 - DNA, 472 bp, Homo sapiens
ataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatag

SEQ ID NO: 25814 - DNA, 402 bp, Homo sapiens
  misc_feature 18, 25, 240: n = A,T,C or G
gctccccaaattctcagnagacagnagtagcccaagttgtgggcctgtggcagagacttcttctattggaaatggtgatggtatttcaaaactgatgagtgaaaattaattgtgcaacatcctggatacatcctgatacaaaagatcagtacattatttttggaactgaagatggtatttacacactgaatctcaatgagctacatgaggcaacgatggaacagttatttccacggaagngtacttggctgtatgttatcaataatactttaatgtcattatcagaaggaaaaacctttcagctctactctcacaatcttatagctttgtttgaacatgccaaaaaaaccaggattagctgcccatattcaaactcacaggtttccagaccgaatactacca

SEQ ID NO: 25815 - DNA, 468 bp, Homo sapiens
tgggttaaaagatggttgtagcatttaaaatggaaaattttctccttggtttgctagtatcttgggtgtattctctgtaagtgtagctcaaataggtcatcataaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataatagggaatgtccaccatgaacttgatacgtccgtgtgtcccagatgctgtcattagtctatatggttctccaagaaactgaatgaatccattggagaagcggtgga

SEQ ID NO: 25816 - DNA, 232 bp, Homo sapiens
gaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaat

SEQ ID NO: 25817 - DNA, 499 bp, Homo sapiens
  misc_feature 6, 29: n = A,T,C or G
tggacnggggttacctgatttcatgatanatgatgcttcttgtcaacaccctcttaagcagcaccagaaacagtgagtttgtctgtaccattaggagttaggtactaattagttggctaatgctcaagtattttatacccacaagagaggtatgtcactcatcttacttcccaggacatccaccctgagaataatttgacaagcttaaaaatggccttcatgtgagtgccaaattttgttttcttcatttaaatattttctttgcctaaatacatgtgagaggagttaaatataaatgtacagagaggaaagttgaggttccacctctgaaatgagaattacttgacagttgggatactttaatcagaaaaaaagaacttatcttgcagcattttatcaacaaatttcataattgtggacaattggaggcatttattttaaaaaacaattttattggccttttgctaacacagtaagcatgtattctctataaggcatt

SEQ ID NO: 25818 - DNA, 422 bp, Homo sapiens
  misc_feature 1: n = A,T,C or G
nagtgttcagtgcttctatttagaaagaagaaaggtgtaaaataaaagaatgaagcttccatcttaagaagctaggaagagttgaggaaatagaacccaaaggaaacagaaagaagaaaacaagaaaatcataaaagtcaaaatcggtcattggaaaaattgataaaattaataaacccttgctgcttctcaaaaaacaatttaaaaaagagggagagacagggctaggaaaaacatgcaaatatccaacctgagagggcttatcccctaaggcaagattgctgaacaaatccttgccagcagttaccagtgatgccctaagaatgtaaaacaggatagaggcttgattttacaaccaaagctttgcagaaaatataaacagtgatagtttgaggggccctacctagtaaaaacatcttcta

SEQ ID NO: 25819 - DNA, 409 bp, Homo sapiens
  misc_feature 4, 6, 29: n = A,T,C or G
tctntngacacggggggaagtagagcggnggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaag

SEQ ID NO: 25820 - DNA, 478 bp, Homo sapiens
  misc_feature 13, 406, 442, 453, 476: n = A,T,C or G
catcccattaatnctcctagccctgggcaaggtaagaccatgacagcaattttttaaatcccatctcggtcttctctaggttgctctgtaagaattgtttagatgtaagctggtgagtgctcaggaagccaaagtttaaagcaaaagttttaagcaaaagagtaacatgagctgatactaaaagccatctcttggcccggtgcaatggctcatgcttgtaatcccagcactttgggaggctgaggcaggcggatcacctgaggtcaggagttcaagaccagcccggccaacatagtgaaaccctatctctactgaaaatactaaaaattaggctggcatagtggcaggcatctgtaatcccagctactcaggaggctgagacaggagaatcgcttgaaccccggangcaaaggttgcagtgagctgaaaattgtgccactgncttccaacctnggcaataaaaatgaaactttttncc

SEQ ID NO: 25821 - DNA, 326 bp, Homo sapiens
  misc_feature 2, 19, 50, 92, 153, 165, 205, 234, 280, 296, 322, 326: n = A,T,C or G
tngccgggggcctccgtanaagctgagggaagttctttgcctgctgtcanaggagcagctatctgattggaaacctgccgacttagtgcggngataggaagctaaaagtgtcaagcgttgacagcttggaagcgtttatttatacatctctgnaaaaggatattntagaattgagttgtgtgaagatgtcaaaaaaagattttanaagtgcaatatttatagtgttatttgttncaccttcaagcctttgccctgaggtgttacaatcttgtcttgcgtnttctaaatcaatgctnaataaaatatttttaaaggacatacnaacn

SEQ ID NO: 25822 - DNA, 301 bp, Homo sapiens
gaaacaattcgggaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattg

SEQ ID NO: 25823 - DNA, 432 bp, Homo sapiens
  misc_feature 2, 11: n = A,T,C or G
gngggcccccnggccggggctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgaga

SEQ ID NO: 25824 - DNA, 187 bp, Homo sapiens
  misc_feature 3, 4: n = A,T,C or G
tcnntggcccgaggaaaaggcaaaactttttctaaagggagaaaccttaaaaatacacccgcataagcctgatctaacaactccatttctaggaatctgtccctaaagagataagcagagaaaagtgctaagatgaatgtaacagggatatttaatagcaaacaatgagaaacaatccagatgtcca

SEQ ID NO: 25825 - DNA, 439 bp, Homo sapiens
  misc_feature 3, 8: n = A,T,C or G
tcngggcncggggaggcattgaggcagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttggagggtgatt

SEQ ID NO: 25826 - DNA, 367 bp, Homo sapiens
  misc_feature 9, 11: n = A,T,C or G
cggccctcncnggccggggtactttctgaacccacttcctttcttgcctttactcttaagggaaaacaataattatttcagatttaaaataaaacagtagattagtgaaatcaaattgagagttcagataaaaacccatataaccagagaatgttcttttcaaccaatggtgcttgggacaactggatatttccatgaaatgggaccccctacttcacaccatatacaaaagttaactcagactatagatcagtgacttaaatgtaagagcttaaagctataaagttcttagaagaaaacatagagaaaaatattcatgaccttggatttggcagtggattcttaggacatcaaaagcatgagcaac

SEQ ID NO: 25827 - DNA, 352 bp, Homo sapiens
  misc_feature 1, 14, 33: n = A,T,C or G
ntaaaagagcacgnggggaactcggccgcgggnacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttgg

SEQ ID NO: 25828 - DNA, 391 bp, Homo sapiens
gaatgtgaacactgaagctacttagtaatctccaaggacctctttcagtagggactcatttagtgaatttgcagaagaaacacacacagattgggagcttcccttccgttctttccactaaatggtggggtactgtttgctgttgtgtgtgtccaaaaataacagacctctttcccaaaaagcacagtctgagacaaggacttagtgtaggtaatttcctggaatggatgtttctgggagacagaggaggaaacgccaaaataaaggaacattatagcacttttggaggctgtggcaggtggatcacctgaggtcaggagttcgagaccagcctggccaacatggcaaaaccgtgtctctactaaaaatacaaaaaattagccgggcatga

SEQ ID NO: 25829 - DNA, 478 bp, Homo sapiens
gttttggaaaattatttttaaataactaaaattagttatttcaagatattatacagtagtaatgattattatatactcaagggtgatttcatgaaaaagttagaacatttcatgtagtggtaaacctttgggtgtttataatagacaacagatagttattagctattacaatgcaagattttatactagaatacttttttatttggtgtatatatatttagcaaggaaaagaatgaacaaacacaagttactacattaaatacatgttcttgagcagttacagggatatgggattattaatgtcaaattctggagaatgtaaagaaaagctattcattatacttgatcttgtttctattaaaaaatcatgtattacagttctatcttacatctccaatgtcaaatgtattataattgagaatggagaattagttatgtaaaccttttatcttacacagtgtaaggaggatagtagaag

SEQ ID NO: 25830 - DNA, 470 bp, Homo sapiens
  misc_feature 2, 20, 29, 30, 33: n = A,T,C or G
tngaaacggggggggggggngggcgttanntgnaccggggggagttgatttcattagttgtttgggttgtttaatccagaatttttaaaactgttatgggtttaatttgctacatttgtccattcttattcatttcatctgttttgatcactgaaaagttgtctaaaaactgtgctcattatacacagtttatagtattttaatactttgtttatagtatttaatagcttctgaaaactttaagagaacatactaaaccaaggaactatttattaatggtaatctatatttagtaataaatatatttgtaacttactaaatgtaagtttactaaatgtagattactaaatcactgagtaaatatttcttgaatatttggacaagagatggggggagggagaatgacttgaccctcaagaaacttaactgctacctttaaaaggttataatgaagctgggcacagtggtac

SEQ ID NO: 25831 - DNA, 439 bp, Homo sapiens
  misc_feature 3, 4: n = A,T,C or G
tanntggaccggggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttggaaggtgatt

SEQ ID NO: 25832 - DNA, 419 bp, Homo sapiens
tctggccggggaaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttt

SEQ ID NO: 25833 - DNA, 229 bp, Homo sapiens
gacaaggaagtggggggacaagtggtccacttttcctgcaacttggtggctgaatacacaatgcaattcctagtccacatcatccctcaattgattgcagtctgtagaaaaaataaaataaaatgagccccttactcaagatttcctcctacttccccagcattctttcccaaaggtgcagaatttcagaaccacagaggtctctcagaactttgtaaacaggcaaact

SEQ ID NO: 25834 - DNA, 331 bp, Homo sapiens
  misc_feature 2, 16, 308: n = A,T,C or G
cnctggccgggaagangcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcacttttcccaaatgatcctagtaattgcctagaaatatctttctcttacctgttatttatcaatttttcccagtatttttatacggaaaaaattgtattgaaaacacttagtatgcagttgataagaggaatttggtataattatggngggtgattattttttttatactg

SEQ ID NO: 25835 - DNA, 295 bp, Homo sapiens
  misc_feature 21, 23, 34, 35, 39, 42, 43, 48: n = A,T,C or G
acgcggggggggggggggttntncggcacggganntcantanntgacntttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgg

SEQ ID NO: 25836 - DNA, 377 bp, Homo sapiens
  misc_feature 4, 9: n = A,T,C or G
gaanggggnaggcattgaggcagccagcgcaggggcttctgctgagggggtaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggacggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaga

SEQ ID NO: 25837 - DNA, 331 bp, Homo sapiens
  misc_feature 1, 16: n = A,T,C or G
nggctttcgctctaanattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaac

SEQ ID NO: 25838 - DNA, 264 bp, Homo sapiens
  misc_feature 16, 23, 35: n = A,T,C or G
aacggggtaacttagnacccatnctgactccaaanccagtgccctctacactagaccacactgtctttcttaggttggatctaaaaaaatactaccagctggttggttttttaactaactgtaggaacacaacctagtattaagtagagtatgcatgctgcatagtggactgaggtagagtaaaacccattattgtaccacttttaggtaagaaaatgtattatctaaggaatatcattaaaatttccttacttccctccatga

SEQ ID NO: 25839 - DNA, 278 bp, Homo sapiens
  misc_feature 4, 15, 48, 262: n = A,T,C or G
gctngggggaaggtnacttcgtgggtgaggctgacatgcctcacacanttacaacagtagagagggaaaatcctaagacagaggaactccagagatgagcgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttattttttatttttttttngtaaagtgattttttg

SEQ ID NO: 25840 - DNA, 421 bp, Homo sapiens
  misc_feature 3, 30: n = A,T,C or G
atngaaagggatgtattagtgtattccagnatatttgattttatcccccttgtctctgattggggcatactagtgacttgtacatcatgaattaaaaccctttaacttctcattaatattgaaacccttagggctctctttttgagccaaataaattattcacattttcaacctggatagtttacacagagcaaatttaagggtgagagaaagcaaagaggaaaattaatttgactggaaaattgaaacaaaaagaaataaaagccttcaaaatttctcttcctaagaaaagcttaaggtgtaccaagcacccatgaacaagacattggattttctcaaatctctttccttggggtgagtttataacttcactgtcatgtctttcaggaaagatacccaaataatagtatgttcaatgagg

SEQ ID NO: 25841 - DNA, 374 bp, Homo sapiens
  misc_feature 351, 366: n = A,T,C or G
tctatggcacggggaaggaagcatgcattataactgtctaactcttctgcgttcatattgatgttaatgggactaaattaccttgctagcttaatgagataagattttaaatgggtgttttatgtactctgtgtgtgtgtatttaatgaagacttggtggtcgcttctgatttacacttgggaatcaattcccctcttgtggctttttactttgtttcctttcattcaccctcgaattaaggcatcctcagtatagaaaattttgaaaatacagaattatgtttaaaaaggtagaaaaatggaggtaaaatatgcacttgaaatctgtcataggcagtgttccaacaccangtcttgtcctcagangaggaaga

SEQ ID NO: 25842 - DNA, 439 bp, Homo sapiens
aaggccggggattagaagaaggcttcactgactcatttaaacttaatacctaccctgtgtgcagaaaagagttaatatagcagacctgagactgctatccttggaaaagcctgctgataagattggccgttagctggcatctgggaacttggatgataaacagctccctacactgatagaaaactttccctaaattataaggtgactcacggtgcatttgtgcacacatagtgatttttgctgaacatctgtttcccttccgggcatccagaattttggtatgtgctaggcttatgtgactagcccctaaccttgggcactgtctctgatgagcttcttttgtacaacatgtgtcacatgtgttgtcacaactcattactctccagtaatgttagtacatcctatttgactccactgatagaggactcttggaagcttg

SEQ ID NO: 25843 - DNA, 436 bp, Homo sapiens
  misc_feature 5, 20, 29, 42: n = A,T,C or G
tccangtatggcggatgaancccgcgacntgttgtgtctganatcccggtgctgaagactgacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacagggggtggcaaaatatgcctgacggatcatttcaaacctttgtgggccaggaatgtgcccaaatttggactagctcatctcatggctctggggctgggt

SEQ ID NO: 25844 - DNA, 100 bp, Homo sapiens
  misc_feature 2, 7, 27, 98: n = A,T,C or G
antttgntaggccggggaggtctaatnacctgaagtcacgagttgctgagtaccagccacgcccaatatggatggacccctgtctaatactaaaaatnca

SEQ ID NO: 25845 - DNA, 361 bp, Homo sapiens
  misc_feature 1: n = A,T,C or G
nttggccgggaatgaggggggaatctaaaagcctttcctgtaagatctggaagaaggcaaggaagcccactttcaccacctttcttcaacgtggtactggaagtcctagccagagcaattaaacaggagaagaaaagaaaaggcatccaaattggaaggaaaaatttagattacccttgtttgcagacaatagtatcttaaatttagaaaaacctaaggactctaccagaaaactgttagaactgaggtttagtaaaattgcaggatgcaaagtcagcatataaaaatcagcagcatttctgtatgccaagagcaaacaatctagaaaataaaccaagaaaataatcttatttccaatagc

SEQ ID NO: 25846 - DNA, 262 bp, Homo sapiens
  misc_feature 134: n = A,T,C or G
tcttttctggatgaagtgatgtatgctttgcatatgagttgccatggtgacagtggacctttccagtgcagcatatgccagcatctttgcacggacaaatatgacttcacaacacatatccagaggggcctgcntaggaacaatgcacaagtggaaaaaaatggaaaacctaaagagtaaaaccttagcacttagcacaattaaatagaaataggttttcttgatgggaattcaatagcttgtaatgtcttatgaagaccta

SEQ ID NO: 25847 - DNA, 402 bp, Homo sapiens
  misc_feature 18, 19: n = A,T,C or G
tactaaaggtaatacttnngaaatacgtgctcatatcattttagaaagaactatttactttttaaagccagtgttgttggggttttcgtaatatgtataacacagatattttaattttaaattcttgacttagtgatttagaaatcatctttgataaatgtagaattcacataagagttaataaatgagggaaaggaataaaattataggtatctttagcctttccaagaagtcagttttcatcctgtagctttaattggacgttattttaggaaatagaatatttttgagaaatttctaagaaggattcaagaaaacatctcacacctgtataaaaatttgtgtctgtgaaagtagaggactagacataaacacaaacttcaggaggggaattaggcaagg

SEQ ID NO: 25848 - DNA, 399 bp, Homo sapiens
  misc_feature 9: n = A,T,C or G
ccggggatnccgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaggcctgtccacgagctcaatagggaagcctgtgatgactacagactttgcgaacgctacgccatggtttatggatacaatgctgcctataatcgctacttcaggaagcgccgagggaccaaatgagactgagggaaga

SEQ ID NO: 25849 - DNA, 362 bp, Homo sapiens
cttttttttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtggtatgctcacttccccatcaacgttgttatccaggagaatgggtctcttg

SEQ ID NO: 25850 - DNA, 423 bp, Homo sapiens
cagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagat

SEQ ID NO: 25851 - DNA, 487 bp, Homo sapiens
  misc_feature 7, 9: n = A,T,C or G
gtaggcntntttggccgggggcgcaatagatatagtaccgcaagggaaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 25852 - DNA, 238 bp, Homo sapiens
  misc_feature 5, 14: n = A,T,C or G
gaganccctgtctntaatttaaaaagaaaagaaaaaaacattcccagtggcagcctgcctaagactgtcttaccttatgttaaggaagtcaggtatttaaaatgttacatatgccggcgcagtggctcatgtgtgtaatcccagcactctgggaggctgagacaggtagatcatttgaggtcaggagttcaaaaccaacctggtctacatggtgaaaccccatctcaactaaaaatac

SEQ ID NO: 25853 - DNA, 100 bp, Homo sapiens
  misc_feature 2, 3, 34, 94: n = A,T,C or G
anncccgggtaatttcggcctctatggcccgggnatctttaaaaataattaaaaaggtcaggtgcggtggctcacgcctgttaattccccagcntttttg

SEQ ID NO: 25854 - DNA, 498 bp, Homo sapiens
  misc_feature 5, 14, 46, 53, 76: n = A,T,C or G
tcgtnctacacganacgtactacgttgtagcctcactttccactangtcctantcaataggagctgtattttgccntcataggaggcttcattcactgatttcccctattctcaggctacaccctagaccaaacctacgccaaaatccatttcactatcatattcatcggcgtaaatctaactttcttcccacaacactttctaggcctatccggaatgccccgacgttactcggactaccccgatgcatacaccacatgaaacatcctatcatctgtaggctcattcatttctctaacagcagtaatattaataattttcatggatttggagaagccttcgcttcgaagcgaaaagtcctaataggtagaagaaccctccataaacctggagtgactatattggatgccccccaccctaccacacattcgaagaacccgtatacataaaatctagacaaaaaaggaaggaatcgaaccccccaaagctggtttcaag

SEQ ID NO: 25855 - DNA, 468 bp, Homo sapiens
ctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcag

SEQ ID NO: 25856 - DNA, 107 bp, Homo sapiens
  misc_feature 1: n = A,T,C or G
naaattgagtttctttctctttaggcctttcacaactaggactgagaatgtatgtaaaagttctgtgacagtacagaaggaaaacaactttttatgtatagcttcta

SEQ ID NO: 25857 - DNA, 500 bp, Homo sapiens
  misc_feature 9, 13, 35, 90: n = A,T,C or G
gtccggccntctntggaccggggattgatttgtgnatgatacacattgtaatttgatgcaatagtttaaggcaataggtacggaaaatgnggtttctatttttcgatttcctgtaaatcagtgacataaataattcttagcttattttatatttccttgtcttaaatactgagctcagtaagttgtgttaggggattatttctcagttgagactttcttatatgacattttactatgttttgacttcctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctccttttcagacagatt

SEQ ID NO: 25858 - DNA, 436 bp, Homo sapiens
ataattaaacatgatcctgagttatctgtattctgaactttcttaattgagaagaggcaggaaatcactgcagaatgaaggaacatcccttgaggtgacccagcaaacctgtggccagaaggaggattgtaccttgaaaagacactgaaagcattttggggtgtgaagtaagggtgggcagaggaggtagaaaataattcaattgtcgcatcattcatggttctttaatactgatgctcagtgcattggccttagaatatcccagcctctcttctggtttggtgagtgctgtgtaaataagcatggtagaattgtttggagacatatatagtgatccttggtcactggtgtttcaaacattctggaaagtcacatcgatcaagaatattttttatttttaagaaagcataaccagcaataaaaatactatttttga

SEQ ID NO: 25859 - DNA, 449 bp, Homo sapiens
  misc_feature 2, 5, 443: n = A,T,C or G
cntcnctggccgggactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacgtcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatgggatgttactctcttgcaccaaattatcttgatacattcaaatttgtctggttaaaaaatagggnggtaga

SEQ ID NO: 25860 - DNA, 380 bp, Homo sapiens
aggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttagc

SEQ ID NO: 25861 - DNA, 467 bp, Homo sapiens
gcccttttgcggccatcaccgagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtagggaaagggaaaagggcaaatacaaggaagaaaccattggagaaga

SEQ ID NO: 25862 - DNA, 377 bp, Homo sapiens
  misc_feature 3, 9, 359: n = A,T,C or G
gancggggnaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatanaagggcaatgcttttaca

SEQ ID NO: 25863 - DNA, 443 bp, Homo sapiens
  misc_feature 3, 4, 190, 220, 222, 269, 328, 389, 398, 416: n = A,T,C or G
ctnnggaccgggattttcaaagagaatgttctcttacatatgttaggaaaataggcacactttcaaagagaggtataggggctttttactgccttcgaaatcacttttaataaaagttgtatgataaatcattaaaaatgcgagtgtaaatattttttttttacctctatcagggtttttatttgaaagngtgctcttaccatttccttgtttgagtaananagtgaatggttctgagtgtttaggaaggatttgcttgcttgcagcanaagttctaggaaaagcaggcacctcccaaatatcttgaggacactggcagccttatggngactaaatccacactttctttaaagagatgcagatgaattacttttctgttaatatatagnaaaaatacncaggagaacatgcagatncatgtaaatatctacatacagggatat

SEQ ID NO: 25864 - DNA, 374 bp, Homo sapiens
gttgtaaaaattaaaacatcttgaagggtaaaagaatgtaaaaatcacttcataccctactgcttagtgatagtggctgtttagagtatttttctcgacatctcttcccttaggtacataacaatattgacacattaattgagcatctgttgtgtgccattcttagagtcacatgcatctttgcattaaaagacagacttggcttgaaggagttagccaggctgagggaaaggatttaggtaaatccagtggaactttccaggaagaaggacaccatagtgaagattctgaaagagctagctgtttttgaaactgacagaacacaaggatgtctgaagcatagagaaggagggagagttaaagaaaatgtagga

SEQ ID NO: 25865 - DNA, 371 bp, Homo sapiens
ctatatggacacatttgcatccacatacagaaatacatacaaaagaatgtatcctttgacctacaggcacatgcacgcctgcccatcatttcatagatatgtaagattttcctcccaccgtgggcgcttggtttatacaatgatggggcttcttttatacttactaattctattctctattatattccaaaagccatcatattatctgccttgtccaattttcttctgtgtctcattaaagtagcctgctgtgaagctaatttttcttgctcattttattgatattttgggagagtgagattttttccaagccattcctgcttcagtatagggttgtggtagctgtcaaaagaaggctttgaaaccatcct

SEQ ID NO: 25866 - DNA, 265 bp, Homo sapiens
  misc_feature 4, 19: n = A,T,C or G
tggncgggggtcattaatnctgctaatctgaaaaactgaatctatcacacaaagggatctatcttccttcctctgtgagaaatgacctatgaagagatgtcagggttgtctgatttcttgttattgggtttttgggattcataggaattgattatactgttagtaaatcaatgaaacatgaaataatgtgtaaatgaatgatgatgaagaatactaaatatggaccaatggtgggtttttgttgggtatgaaccaaggattaaga

SEQ ID NO: 25867 - DNA, 326 bp, Homo sapiens
  misc_feature 5: n = A,T,C or G
agggnatatttttaaatacttgtttctaataatacctcttagcagtaccttttaaataagtataagggatggcaaagtttttccctttaaaaatactcactttatgcttataaataggttaatgggctgataaaaggttttgtcaaacattgcaagtattcggtgctatatataaaggaggaaaaactagttttactttcagaatgatttaaacaagatttttaaaaacaagatacatgcaagcgaacagcagggttagtgataggctgcaattgtgtcgaacatcagattttttgttaggagcaaatgactcaatctgatttaga

SEQ ID NO: 25868 - DNA, 355 bp, Homo sapiens
  misc_feature 3, 5, 339: n = A,T,C or G
tcncnggcccgggggttatgatagcactcagcaatacggaagtaatgttccaaatatgcacaatggtatgaaccaacaggcatatgcatatcctgctaccgcagctgcacctatgattggttatccaatgccaacaggatattcccaataagactttagaagtatatgtaaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttagggnttttttttgtactaga

SEQ ID NO: 25869 - DNA, 475 bp, Homo sapiens
  misc_feature 148, 163, 167: n = A,T,C or G
gagagcatgcccttctggcttacacactgggtgtgaaacaactaattgtcggtgttaacaaaatggattccactgagccaccctacagccagaagagatatgaggaaattgttaaggaagtcagcacttacattaagaaaattggctncaaccccgacacagnagcntttgtgccaatttctggttggaatggtgacaacatgctggagccaagtgctaacatgccttggttcaagggatggaaagtcacccgtaaggatggcaatgccagtggaaccacgctgcttgaggctctggacttgcatcctaccaccaactcgtccaactgacaagcccttgcgcctgcctctccaggatgtctacaaaaattggtggtattggtactgttcctgttggccgagtggagactggtgttctcaaacccggtttggtggtcacctttgctccagtcaacgttacaacggaagtaaaatct

SEQ ID NO: 25870 - DNA, 310 bp, Homo sapiens
  misc_feature 8, 11: n = A,T,C or G
tccggccntcnatggaccggggaggcattgaggcagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagc

SEQ ID NO: 25871 - DNA, 415 bp, Homo sapiens
  misc_feature 3, 19, 40: n = A,T,C or G
ganagggggattcctgaanctgacagcattcgggccgagnatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagactagtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggagg

SEQ ID NO: 25872 - DNA, 350 bp, Homo sapiens
gcctcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatga

SEQ ID NO: 25873 - DNA, 343 bp, Homo sapiens
  misc_feature 6: n = A,T,C or G
aagatnaacacaaaaatatcaattcactagcaacgagtacacggacaccaaaataaaagctaacattccatttacgattgctcaaaaaatgaaacacttagatgtaacaaaacacgtacaggatttgtatgctgaaactagagaatcctgatgaaaaaattcaaagatctaaataaagggagagccaaattgtgttcatgaacttaatatagtgaatttatcaattctccccaaactgatattcaaatttaattcaatacctatcaaaatcccagcaaaaaatatttatagagacaagattcttcaaaaattcatatggaaaggcaaaggaactagaatagct

SEQ ID NO: 25874 - DNA, 238 bp, Homo sapiens
  misc_feature 3, 6: n = A,T,C or G
ctntcnggccggggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgag

SEQ ID NO: 25875 - DNA, 303 bp, Homo sapiens
  misc_feature 237, 267, 282: n = A,T,C or G
atgtctcgctcccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggnctggtctttctatctcttgtgctacactgnattcacccccactgnaaaagatgagtatgcctgccg

SEQ ID NO: 25876 - DNA, 475 bp, Homo sapiens
gttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtc

SEQ ID NO: 25877 - DNA, 444 bp, Homo sapiens
  misc_feature 4, 24, 28: n = A,T,C or G
gaangggggggggggggggaggtnaggnaggggtgaaataaacatactaacacattcgcctcctagtgttatcatgagaactggctctgagaaagcagtcagtgaatgttagatattattcttttatttcattgttagtgtcttcctgctgctttaactaagaaagtgatttttaaaacctgctcaatgtatataagaagtttcacctaccgtctcaaagataaggcaaggatctccctgaacagagtttgtattttttgtggcttgcccagttctgtataacattgtgcatttttcttcctttttgtatttagcgaatacaaataagaaaaacagaagaggctagatgtagtgactcacactttgggagaccgaggtggtaatatcacttaagccaagaaatttgagaccagcctgtgcaacatggctagaccccatccctac

SEQ ID NO: 25878 - DNA, 469 bp, Homo sapiens
  misc_feature 19: n = A,T,C or G
cttcagatggatgtccagngatccaagggccaccttacagacgctcagtgagtatcgtcagtggttaagggaagcgcactgcgctcctggacttatgcatccgactccctgctttatgacaagtgccgtgtgaccttgggcacatgccttgggagttgtttcccttgtaaaatggagataggaacactctcttggcctcacagagctaatataaaatggatcaaatgaaactggttatgaagttgttttttaaatgctgaagtgctttagaaatccgctatgtaggctgggcgcggtggctcatgcctgtaatcccagcactttgggaggccgaggcaggtggatcaccggaggtcaggagttcaagaccagcttggccaacatggtgaaaccccatctctactaaagttacaaaaaaattagcccggcatagtgggggggcacctgaaatcccagctactcgggaggc

SEQ ID NO: 25879 - DNA, 283 bp, Homo sapiens
  misc_feature 2, 5: n = A,T,C or G
cnctngccgggaaattaaaaaaatttccttctaaaaatatgctaagactttttaaatgtcatatgttatatggatgtttaattctatttttttctttactaagttttccttttaaatctgttactaaggtgaattttattaataacaattctaatagtcaaattgctggaataaacccaacttgatcatgatgtatcatcttttatttttcattgctggatctggtttggtaatatttgttcagaatttttgcatccatgttcataaagtgagattgaattgg

SEQ ID NO: 25880 - DNA, 366 bp, Homo sapiens
gtgtgtacccaaagttagattcaataatccaattatgagcgaaaatacttaaaattgctaataggcgctttgtactttattagttaccaggaatatgaaataaaatgtgaatcatgggctaatgatttgccaaagaaagatgcatgaattatattttttgtgttttgttttagtttaagtcaagtaaatagctataagtctagcaattccgaatttgaattgattaatgttacatttctttggcgcctgctgtttttatctcagggtggattattttttcagagttgaggagttgacctcttttgtttgtagaagaaaggagtgttttttaaaaaatgcaaaaacattagtaggccaacattgtat

SEQ ID NO: 25881 - DNA, 461 bp, Homo sapiens
  misc_feature 407, 437, 446, 452: n = A,T,C or G
agtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaaggatggcaatggctatattagtgctgcagaacttcgccatgtgatgacaaaccttggagagaagttaacagatgaagnaagttgatgaaatgatcagggaagcagatnttgatgggngatggncaagtaaac

SEQ ID NO: 25882 - DNA, 169 bp, Homo sapiens
  misc_feature 5, 6, 25, 26, 35, 48, 65, 103, 108, 148, 155: n = A,T,C or G
caatnnaggccgggggaaacacgannctactgcgnaacattgctgggnttcctgggcagaaattnatataaactgtgatactcacattccttgaagctatgancattnaaaaactgtgtacacgtcaccatagggattcaaaagaatntggaatnaactggtgaagttt

SEQ ID NO: 25883 - DNA, 372 bp, Homo sapiens
  misc_feature 7, 38, 108, 110, 118: n = A,T,C or G
ccggccnttattggcccgggggccatccctcctgaccngacagaaggttgatctttgctgggaaacagctggaagatggacgcaccctgtctgactacaacatccagnangagtcccncctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgaggg

SEQ ID NO: 25884 - DNA, 393 bp, Homo sapiens
  misc_feature 357, 369: n = A,T,C or G
acttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaggtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtntccaaccaactnggttctgcttcaataaatctttgg

SEQ ID NO: 25885 - DNA, 248 bp, Homo sapiens
  misc_feature 18: n = A,T,C or G
gagatcgacgtgctgagnacgttcttctgataaagtatctaaactagaaggtcaagtagaatcttataaaaagaagctagaagaccttggtgatttaaggcggcaggttaaactcttagaagagaagaataccatgtatatgcagaatactgtcagtctagaggaagagttaagaaaggccaacgcagcgcgaagtcaacttgaaacctacaagagacaggtagtagaactacaaaacagattatccg

SEQ ID NO: 25886 - DNA, 484 bp, Homo sapiens
  misc_feature 4, 12, 437: n = A,T,C or G
tagncacggggnaaacaacatctctactaaaatacaaaaattagccaggcgtggtggggcacgcttgtaatcccagctacttgggaggctgaggcaggagaatcacttgaacccaggaggcggaggttgcagtgagcagatgcaccattgcactcctgcctgggtgacaagtgcgaaacttcgtctcaaacaacaacaacaacaacaaagtctattcaaggctgggtgcggtggctcatgcctgtaatcccaacactttgggaggccgaggtgggtgtatcacttgaggccaggagttcaagactagcctgggcaacatagcaaaaccccatctctactaaaaatacaaaaattagctgggcatggtggtgcaaacctgtgatcccagctactcgggaggctggggcacgagaacgcttgaatctgggaggcgggangttgcaataagctgagattgcaccactacacttcagcctgggtgaga

SEQ ID NO: 25887 - DNA, 108 bp, Homo sapiens
  misc_feature 7, 13: n = A,T,C or G
aaagggnggtaangcaaattcaaaatgctgtcaacggggtgaaacagataaagactctcatagaaaaaacaaacgaagagcgcaagacactgctcagcaacctagaag

SEQ ID NO: 25888 - DNA, 366 bp, Homo sapiens
  misc_feature 4, 66, 78, 87, 100, 101, 122, 140: n = A,T,C or G
tctngacacgggcccgtcacacatggggaaacttagtatagtagcaggtgaaggtattttttccangattaccaaatnactgtctgngctgggattcgtnnccaggccgcctgactccaaantcaatattcttaactctnttgttatgatggagaaaggcatgaagtctaccttcaaattcatggcattttagaaggaaaaattgtcgcaagtaatgtgattatacttcctagttttataggtcagaaaaatgaggtccacactaattttgcctcttccacagggagatagattctcatctaccattgtgtcttttgtttctgtttttgtcatgatacctcaaattgatatatgttgtaattatga

SEQ ID NO: 25889 - DNA, 441 bp, Homo sapiens
tatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaagggaggagtcaactaatgaagaaatgaataataaaatttttgacactgaaaaacattttattaataaaggaatatttgac

SEQ ID NO: 25890 - DNA, 345 bp, Homo sapiens
  misc_feature 324: n = A,T,C or G
atcaataggaaagcatatgcagccaaccaagatgcaaatgttttgaaatgatatgaccaaaattttaagtaggaaagtcacccaaacacttctgctttcacttaagtgtctggcccgcaatactgtaggacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggtgattattttttatactg

SEQ ID NO: 25891 - DNA, 357 bp, Homo sapiens
agggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgtttgaagttaagttttccaataatgtgacttcttaaaagttttattaaagggggaggggcaaatattggcaattagttggcagtggcctgttacggttgggattg

SEQ ID NO: 25892 - DNA, 469 bp, Homo sapiens
gattcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattg

SEQ ID NO: 25893 - DNA, 491 bp, Homo sapiens
  misc_feature 2: n = A,T,C or G
gnaggcattgaggcagccgcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtgattaaaagaccttgaaat

SEQ ID NO: 25894 - DNA, 482 bp, Homo sapiens
  misc_feature 32: n = A,T,C or G
gattcctgaagctgacagcattcgggccgagnatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatac

SEQ ID NO: 25895 - DNA, 454 bp, Homo sapiens
  misc_feature 3, 13, 24, 45: n = A,T,C or G
tangtcggcctcnatagaccgggnatatcagctgacactgatagnattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagatattttaagtactctggatagac

SEQ ID NO: 25896 - DNA, 376 bp, Homo sapiens
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtaga

SEQ ID NO: 25897 - DNA, 467 bp, Homo sapiens
  misc_feature 5, 10, 28: n = A,T,C or G
cctcnatagncggggccttttcacaagnatggcgccgaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtgggatgttaaagccaacaagcaccagattaaacaggctgtgaagaagctgtatgacattgatgtggccaaggtcaacaccctgattcggcctgatggagagaaagaaggcatatgttcgactggctcctgattacgatgct

SEQ ID NO: 25898 - DNA, 253 bp, Homo sapiens
gctcttctaaaatagtgtttccctgactttgggcagtttgagtacaaacctcacaatttttgacatgtctgcacaccatttgttcttttacctgctgaccatgttttaaaaatctactttgtaaagtaaatcagaaaagggaactgtaatcactacatgactggaaaatcagtggtgcttactggtgtagattagtgtaaaagtaaataccattaaaaaaccccaacctgggcaacatactgagatcttgtct

SEQ ID NO: 25899 - DNA, 220 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagc

SEQ ID NO: 25900 - DNA, 200 bp, Homo sapiens
atagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctac

SEQ ID NO: 25901 - DNA, 486 bp, Homo sapiens
  misc_feature 2, 30: n = A,T,C or G
gnagcatttaagaagcatcctctgccaagnaccaaaaggaaagaagaaaaagggccaaaagccaaaatgaaactggtggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccatttctgatttcccacaaactgcactacatcagtataactgcatttctagtttctatatagtgcaatagacatagattctataaattcttacttgt

SEQ ID NO: 25902 - DNA, 192 bp, Homo sapiens
  misc_feature 2, 12, 45, 64, 105: n = A,T,C or G
gnaggcattgangcagccgcgcaggggcttctgctgagggggcangcggagcttgaggaaaccncagataagtttttttctctttgaaagatagagattaatacnactacttaaaaaatatagtcaataggttactaagatattgcttagcgttaagtttttaacgtaattttaatagcttaagattttaag

SEQ ID NO: 25903 - DNA, 440 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagatagaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaagg

SEQ ID NO: 25904 - DNA, 101 bp, Homo sapiens
  misc_feature 14: n = A,T,C or G
ccggaaggttgagnatgaagcttcttcatggcagtaaaaaatgtatttaaaagcaaaattgagagaaaggactacagagccccgaattaataccaatagaa

SEQ ID NO: 25905 - DNA, 253 bp, Homo sapiens
gcatggaagtcagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaagaagagttaaaacaacacatgtaaatgccttttgatatttcatgggaatgcctctcatttaaaaatagaaataaagcattttgtt

SEQ ID NO: 25906 - DNA, 244 bp, Homo sapiens
tgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagct

SEQ ID NO: 25907 - DNA, 431 bp, Homo sapiens
ggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatac

SEQ ID NO: 25908 - DNA, 440 bp, Homo sapiens
  misc_feature 5, 27: n = A,T,C or G
gggcncggggaaaccacactggggaantgggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttattttttttaccaattccaatttcaaaatgtctcaatggtgctataataaataaacttcaacactctttatgat

SEQ ID NO: 25909 - DNA, 485 bp, Homo sapiens
  misc_feature 4, 11, 75: n = A,T,C or G
gtcntcgcccnatagccgggagcctttaagaagcatcctctgcccagcaccaaaaggaaagaagaaaaagggccnaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagatcgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcataga

SEQ ID NO: 25910 - DNA, 422 bp, Homo sapiens
  misc_feature 2, 23: n = A,T,C or G
angcgccggggaaatgtcggccntctatgggccgggggcgcaatagatatagtaccgcaagggaaagatgaaaaattataaccaagtcataatatagcaaggactaacccctataccttctgcataatgaattaactagaaataactttgcaaggagagccaaagctaagacccccgaaaccagacgagctacctaagaacagctaaaagagcacacccgtctatgtagcaaaaatagtggggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacactaggaaaaaaccttgtagagaga

SEQ ID NO: 25911 - DNA, 494 bp, Homo sapiens
  misc_feature 4, 9: n = A,T,C or G
tcangggcnacaaattaaataacaatagtatttgattataacctaaagcaataaaacaaatatccatgtgtccatacttacagaagaatttcaattaatgaatgtagaataaatgagggaacctttaaaacaccgtaataataattgttacaagataaagttagtgggtaaaggagaatcacaatatttgcatagttacaagatatctccccaaaaacacttacaaagttaaatagtaactttactgtagaggaacctgtgggacactgccttaaccaagtgatcatggttaattctaacaagtaataaaacttgtatcccctggacctaaagcactgagaaagatgcatcacctatatggaatctttccccaaaaaatgcataacgtctatccagtcatgagaaaacatcagaaaaacctaaactgaggatattctacaagataactgaccaatactgttcaaagtgtcaaggtcataaaggacagggagaga

SEQ ID NO: 25912 - DNA, 286 bp, Homo sapiens
acaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttg

SEQ ID NO: 25913 - DNA, 324 bp, Homo sapiens
  misc_feature 37: n = A,T,C or G
aattcgaagcaataacatcaacacactgttcaaaatnatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcaga

SEQ ID NO: 25914 - DNA, 413 bp, Homo sapiens
  misc_feature 21, 23: n = A,T,C or G
tatggccgggatatctcgaanantttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtggggactatgatactgtaataatatttttaaaaatttacatcaagagaggcagtcattcacgatgggttttgtgccagctctttttagg

SEQ ID NO: 25915 - DNA, 491 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctgggaggctggcacctgattttgtatccccctgtagcagcattactgaaatacataggcttatatacaatgcttctttcctgt

SEQ ID NO: 25916 - DNA, 409 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttta

SEQ ID NO: 25917 - DNA, 283 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcat

SEQ ID NO: 25918 - DNA, 382 bp, Homo sapiens
tgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcctgtcacaaaagtgccactaaaacagcctcaggagaataaatgacttgcttttctaaatctcaggtttatctgggctctatcatatagacaggcttctga

SEQ ID NO: 25919 - DNA, 472 bp, Homo sapiens
ggactaacccacagggaaaatggattagtaaaaagcttaggacaattaacaggaaaattgcattaaggttaatcccttggatatggtgccatggttaaatcacccacagatttgttattcataaatgtatttatcttaaatatttaaaatgggcatttaagaggaatttaatatacagtttgtttaaggtccacgttttttaaaacgttaattacttatatccttatttatacagaatttttggttcagtttagttacctcaactttgctttccctgtgcttataacaagttttaagaaagatgagttttaaaccttttgtttcctgactgaataccttaacattttccccgcatatatacatgaatacacacacgccatacacacacacaaaattgacattgtttaccttttgtttatttctaggaatcaagactatttggactcagtgtcagccactactaatatttata

SEQ ID NO: 25920 - DNA, 456 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttg

SEQ ID NO: 25921 - DNA, 450 bp, Homo sapiens
  misc_feature 197, 199, 267, 283, 291: n = A,T,C or G
ggggaaaatgaaggttaggatttaacagtcatttaaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctttaaatntntaaaaagaaaagataaagatgatctactcagaaatttttatttttctaaggttctcataggaaaagtncatttaatacagcagngtcatcanaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgt

SEQ ID NO: 25922 - DNA, 278 bp, Homo sapiens
gaggcaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacagaagtacgggaaggcgaagaaaagaatagagaagatagggaaattagaagataaaaacatactttt

SEQ ID NO: 25923 - DNA, 252 bp, Homo sapiens
  misc_feature 6, 12: n = A,T,C or G
tatggnccgggnacagtacatggatgtgcatgtctcatgacattcatctctttcgaaaatatactttagaacatttctcttggagctcctaagaaaaataaatggttggtggtggcccggatggtaggaagacaggttaggatgaaacaagaaatttttcttagtagttataaatctctcaaggggaaaagttagagccccaacacttgactcatttagaacaagttgaaccaacctctgaaaaataaactc

SEQ ID NO: 25924 - DNA, 289 bp, Homo sapiens
ggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatg

SEQ ID NO: 25925 - DNA, 383 bp, Homo sapiens
  misc_feature 78, 99, 105, 146, 197: n = A,T,C or G
attctaattcaattgcaagcagtgggagtaaatgacttctgtccaacagtgccaaagatgaagaaatctttatacagngcaataagtttattgcaacancccggngaaatactgggaaatgcacacctgcaacatttcgttgtgtnttgagcagaatgagtgttcagcttgggaactttggaatgtaataattagtnattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgaga

SEQ ID NO: 25926 - DNA, 182 bp, Homo sapiens
  misc_feature 75, 182: n = A,T,C or G
atttaaaaataactaaaaagtataattcgattgtttgtaacacaagggataaaggcttgaggggatagatacttnctttaccgtgatgtgattataaagtattgcataactacattaaagtatctcatgtaccccataaatatatgtgcctactatatacccacaaaaaataaaaattagcn

SEQ ID NO: 25927 - DNA, 381 bp, Homo sapiens
gtaatcctcacataaacagaaacaatgagaaaaacaacatgattatctcaatagatgcagaaaaggcctttgacaaaattctacagcccttcatgctaaaaagtctcaataaactaggtactgatggaacatatctcaaaatcataagagctatttatgacaaactcacagcaaatataatactgaacgggcaaaaactggaagcattccctttgaaaactggcacaagacaaggatgccttctctcaccagtcctattcaacatactattggaagttctggccagggcaatcaggcaagagaaagaaataaagggtattcaattaggaaaagaggaagtcaaattgtctctgtttgcagatgacatgattgtatatttgg

SEQ ID NO: 25928 - DNA, 311 bp, Homo sapiens
tcttgtgaaaataacctcaaaaagaaaaatacgactctgttgtcttacttgatatttcttgccctagtaatgtacttgacatttatgttcctaagcagtgtaagtaccagtagaatttctctgtcaaactcaatgatcatttagtacttttgtcttctcccatgtgcttgaaggagaaataaagtgtcactaccgtatttcttgttttcatcaaaaaataaaaataatttaaaaaattctgtgttgtctaggttaatttaaggttgggaaatcattaaagttatcaaatgataccagtaactatcatcctg

SEQ ID NO: 25929 - DNA, 104 bp, Homo sapiens
  misc_feature 37, 104: n = A,T,C or G
gatattccgtgaatgtatattgtcttgtaatgttgcntaatgttcactttttatagtggggcctttattctaaacagaaaagaggggttatttctatcacacan

SEQ ID NO: 25930 - DNA, 388 bp, Homo sapiens
aagaataagtgagactgaatctgcaatggcagaaattgaaacagcagcatctaagcagcttcaagaattagcattgcaaagtgaacaggtcctagaaggtgcacagaagacattgctgttagccaatgaaaaagtagaagagttcaccacatttgtgaaggctttggccaaagagttgcaaaatgatgtccatgtggtaaggcgacaaataagagagcttaaaaaaatgaagaaaaacagggacgcctgtaaaacctcaacccataaagcccagaccttggcagcttctatcctgaacatttcacggtcagatttagaggaaatattagacaccagaagatcaagtggaaattgaaaaaacaaaaattgatgctgaaaatgacaagga

SEQ ID NO: 25931 - DNA, 427 bp, Homo sapiens
gggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacgtcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatggtttagtcagcatgctcaggaaataaatgtgaattg

SEQ ID NO: 25932 - DNA, 220 bp, Homo sapiens
  misc_feature 2, 19, 28, 29, 36, 41, 64, 66, 84, 104, 132, 154, 177, 203: n = A,T,C or G
gngacgacttgttgaaatnaccctactnncgatctntacangatcactgggttcaggatctgananagaaaatcaatgaaggtnggagccgtcatctttgtacnagaacagcagcagtgtttctatgtactntttcctctaaaagaatgaagcnaatttttagggagaagagtaaangtttaatttgattgaaattattgggntttctgcagggcatttc

SEQ ID NO: 25933 - DNA, 262 bp, Homo sapiens
ggcgcaatagatatagtaccgcaagggaaagatgaaaaattataaccaagcataatatagcaaggactaacccctataccttctgcataatgaattaactagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataagg

SEQ ID NO: 25934 - DNA, 449 bp, Homo sapiens
accctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacagttaaggg

SEQ ID NO: 25935 - DNA, 172 bp, Homo sapiens
attccttctctctaataatatttactgttcctcaaagaattgtctacattacccatctcctcttttgcctctgagaaagagtatataagcttctgtaccccactggggggttggggtaatattctgtggtcctcagccctgtaccttaataaatttgtatgccttttctctt

SEQ ID NO: 25936 - DNA, 426 bp, Homo sapiens
  misc_feature 3, 129, 248, 257, 306, 380: n = A,T,C or G
ggnggggacacagaaccaaacctatcaactacctattattctcttacatagcaatagcagtagtagtgaagatgttactcattacttgagtactgattgtgtgactggtcctaattctataacagtgtntattaatcacttacaatgtctgaggcaggaatgctaaccagtttacatgcatgatatcacttaatcttgacagtaatgatgtattttgtgtccaaggaaaactgaggtttagagaaatnaggtaattnaccaaaatcataacctaagttaagagtcagatcaagattcttgtctgtntggtggcacaggccatgagattatcaagttttagccttctctgtgaatctctttttcagtatatctgataaatngccatccaacttctggtttaatttgtgaagtaaagggggttctcat

SEQ ID NO: 25937 - DNA, 339 bp, Homo sapiens
gggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggg

SEQ ID NO: 25938 - DNA, 414 bp, Homo sapiens
  misc_feature 412: n = A,T,C or G
gggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcggaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccggggggtgaangg

SEQ ID NO: 25939 - DNA, 467 bp, Homo sapiens
gacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtgggaggaagctttccttgcccatgccattaaggcattcactaaggttaattttgattctg

SEQ ID NO: 25940 - DNA, 462 bp, Homo sapiens
  misc_feature 25, 264, 268, 276, 325, 361, 373, 425, 448: n = A,T,C or G
gaatggaattttgttgactttaatngcaagcagtagttcattaccctaaagattctgttgttgtttttttttccgattctgtgaatataattttaaaattaataatcaattaagtgtaacatttagtagaaagatttttaccattgagccttaaaagaccgtagctaaagctggagggtcatgaaaaataaagaaatcattcaactttgggggttttttttccctaagatgttaatttcctttattcccatgtaacattctgtncagngaactgtnctttaattacttatggaacttttaaaaagtccacttacaatgtataggngatgacttatttcatttgtcaagatcagttatgtancagctgtttggnggtgacgtgaaatcataatatttgatggcattaagccctaaaggactgtgtnccccattagcatgcagctaccanagcctagtttttac

SEQ ID NO: 25941 - DNA, 449 bp, Homo sapiens
atagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccta

SEQ ID NO: 25942 - DNA, 400 bp, Homo sapiens
  misc_feature 365: n = A,T,C or G
ggatgggttaaggtaaaaggctgatcacagatgggttcctctcaaggttaaaatagtttaagtgccagaagaaaaggtgggcaccagtgaattaagaaccatctttgaatggtcaccttggttaaatacttaacttttgtcatcagtgtctgcatttatgaaatgaagaggaattcactaatatgctacgtgatcttttgtttgtcatgaaaagagttactgttgtgtagttctctgttccagggctgcctctgctccacaaagcactgagaagcagtggccctgtacaaccatactgcctctcaacactgtgtaataggctaacaccgcccagcgaaccttcctgggagatatagatacattanggtttaaggctgacaaaaattaagagaacagaggc

SEQ ID NO: 25943 - DNA, 459 bp, Homo sapiens
  misc_feature 7, 19: n = A,T,C or G
cccctcnatggcccggggnaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataatttgaagg

SEQ ID NO: 25944 - DNA, 102 bp, Homo sapiens
  misc_feature 92: n = A,T,C or G
atacacagttatataactgtgctattatgtatagtttgaatatatataatatgtgtgtgtgtgtgtatatatatatatatatatatatgtanacaaaaaatg

SEQ ID NO: 25945 - DNA, 326 bp, Homo sapiens
gaattctgtatgcacatacttttgatttgcttttaatgaagttcaggaaagtagatgaaataggaaacaaacatttaaaaaacattcaacctcactagatgtcattatgtatttgaaaccaccaatagtttaaaataatgagaacattcaatatatgtaagattatagtgatgataacaatatattgctggttgcaacatagataacatctttttagaaaacaattttgtaaaaggactcaagaattatgaaagatcatagcctgtgatctcatattattacttggaatttatgctctttccatgtaaaagaagaaataaagcatg

SEQ ID NO: 25946 - DNA, 401 bp, Homo sapiens
  misc_feature 358, 389: n = A,T,C or G
tatggccgggggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacatcaccattgccactgatttttttttaaatggtaaatgaccttgtatataaatattgccatatcatggtacctataatggtgatatatttgtttctatgaaaaatgtattgtgctttgatactaaaaatctgtaaaatgttaagttttggtaatttttttttctgctggnggatttacatattaaaattttttctgctggnggataaacattg

SEQ ID NO: 25947 - DNA, 441 bp, Homo sapiens
  misc_feature 50, 349: n = A,T,C or G
gttttgtttttagagtataagtagcattagtaaattagcttaatgtgcanccaagtagttgttattttaagaacaatttgtgctttaactatcaattagtattattttatctttccaagttattttactaaattgcttcatacaattgcttttgtcagtcaagtaaaatagtcatttcgattgcattgtattagcaacatagaaaacaactactgcaaaatataatgggaaattaaactctcacaggttgtaaactgtctccctttgaatccttgtctgaagaaattaatttgaactatgccttctaaataggtacaggtgagtcatctagatttcattaaacattttnttttaaggggtttttgttaccttggttcttttaaaaagttaaactttgtttggaatttatctttcaagtatttccttttcagcttgttcacg

SEQ ID NO: 25948 - DNA, 230 bp, Homo sapiens
tatggccggggaatttaagtttcaataggaacacagtattttattagaaagagtgctaagctgagattcaagtgcccttaattctatttagttttagatcatcggtaaattattctccaatcgtgttaacttctctagaaataattcctgcccctacatactttctaggtgctttgaaagaaaaaaggaacaaagtaaaatttagtctgttttgcaagtaaaatcagtac

SEQ ID NO: 25949 - DNA, 465 bp, Homo sapiens
  misc_feature 149, 308: n = A,T,C or G
ggctacaagtgatgagaaagattctttttcgaatataaccagagaaaaaaaggatggagaaacatctaggacagtgtcttctcagaaaccaccagccttgaaggctacaagtgacgaggaagattctgttttgagtatagccagagaanaaaaggatggagaaaaatctaggacagtgtcttctgagcaaccaccaggcttgaagtgtcttctcggaaaaaagcagccttgaaggctacaagtgatgagaaagattctttttcaaatataaccagagaaagaaaggatggagaaacatctaggacagngtcttctcagaaaccaccagccttgaaggctacaagtgacgaggaagattctgttttgaatatagccagagaaaaaaaggatggagaaaaatctagaacagtgtcttcagagcaacccacccaggcttgaagtgtcttctcggaaaaaagcagcctt

SEQ ID NO: 25950 - DNA, 470 bp, Homo sapiens
atataactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctcttttttttgctgtt

SEQ ID NO: 25951 - DNA, 474 bp, Homo sapiens
gactcctctagagtataacaaaaggctccagattttacagaaaaagattttaaaaatatacttgaatactggattactttcctttaccaaatggttgttcttaaattctactttgttaaaacaagaatatttgtggaggtaaaagtgaaaataagctttgcttgcataatcaatcttatcattttatttaaacaagcctgcgcttcctgcttctttagaacagtgaagaaagatcggaaaactgctaatcagcagaattgagagatgtttcttaaccgttcaatgttttcatgggaaaacattccaaaaatgatgaagacaacacccttgtaataaaaaccttagagctcacccttcctgcagattttagcaggccccatgatgagtgacacatatttactcattaccctaattgtcttggctgtgagacaagaaagctaagaatttgttttgggcagaggatgtctagggagt

SEQ ID NO: 25952 - DNA, 467 bp, Homo sapiens
ggaattagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatggaagaagttgatgaaatgatcagggaagcagatat

SEQ ID NO: 25953 - DNA, 472 bp, Homo sapiens
aatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagta

SEQ ID NO: 25954 - DNA, 466 bp, Homo sapiens
cttttggagagaagtgtttaacgatcccaaagttctcaagtcctattattatgccatctctgattttgctgtaggtggcaggtaagtaaactattaaattagtcttgaaagtgtttggagcttttgcatagaggtgaatctagcaacttgtttacaactatgttaataccgttgttagatgttttctttaccaagaataggagcggcagtccttcctgtgtgataatgcttagctgaaaagacggacagcagcctaggatattttcactgtgagatcttcttgttgttctggaaactaagcatgtaggttttccaaaaccttgtcaaatccacacatttagtgaattcttattgacaatttaagtgcaagggcactgtgaagcacttgaggaagggtaagactcaccttatcctacggagaagtcctgaccttcttggatcttacacatgaacagggtaggcaatg

SEQ ID NO: 25955 - DNA, 152 bp, Homo sapiens
agttcaactttaaatttgcccacagaaccctctaaatccccttgtaaatctaactgttagtccaaagaggaacagctctttggacactaggaaaaaaccttgtagagagagtaaaaaatttaacacccatagtaggcctaaaagcagccacc

SEQ ID NO: 25956 - DNA, 486 bp, Homo sapiens
  misc_feature 481: n = A,T,C or G
ccttatggccggggaactcggtggtggccctgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtgggaagaagtgggggngggac

SEQ ID NO: 25957 - DNA, 470 bp, Homo sapiens
cattgctgggtcctcaatgcagggggccatttcatagatgaaaatggctctcgccttccagcaattccctgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcattttt

SEQ ID NO: 25958 - DNA, 403 bp, Homo sapiens
  misc_feature 10: n = A,T,C or G
ggatgcaagnagtcagcatggaaactcatctgttcatgaggaaagtggagtaatgttaaagagaatgcaggtggagcgtgttttcaagagcagcttgtcaatggtatcaaatgctgctcagggaccaaataaaatgaggaccgagaattgtgcatttggcgagggagtgttcatcgttgacactgacctgcagtgtgtcagtggaatggtggggacaaaagactgcctgaagtaagttggtgttcagatgagaggtgaggaagaggagactgaaagtctcgatagttctttggagtagttttgctttaaagagttgtagagaaatggaatgagagctggagaggcattaggttctcaagggaggggttttaaaagaaggagatagtatagcaagtttatatgc

SEQ ID NO: 25959 - DNA, 474 bp, Homo sapiens
aaggacagagaaaagagaaaatagatgccgtgtttggttaggggattatgggcaacatcctttatatgctgcttttaaactaagtcaacataggtttttattgcaggaagaagttcacatttgtgtctaccaaatgacaacatgtaaagcttggaattgagttggttttaggtttttctgtgtatcacttggaggttttctgtgtataactttcttgtattacttggagattttcaggttattggcaccacaggagcagcattattgccagcagacccggggagctggttggagagtcattgcgacttaatttaccctgagctaaaattattatgagtgggccttaatataccagttgttcccacctacacatctagccttgcctttgctgggataaatttgtatacccttcagaggttagattcagaagtacctcctttaggaattatttttagaacctagatctggggtgta

SEQ ID NO: 25960 - DNA, 422 bp, Homo sapiens
  misc_feature 8, 11: n = A,T,C or G
ctcccagnatnagataagcaattacggaaagattacaggatacaggtcaatcactttcctatatatcaacaatgaacaagtggaacaaatgttgaaatttaaaacattctaccatttatgttagcacaagatgaaatatttagccacaaatctaacaatatgtgcgagacctatgtgcaagacctctatggggaaaactacaaaattctgataagagaaattagagaaaaactaagtaaatggtgaaatatttcatgttcatgtatagaaagaatcagtattgtcaagatgtcagttcttcccaatttggtctacagattcaatacaattgaaataaaaatttcagcaaattgtatcgtggatatcaacaaattgattctaaagtttatattgggagggctgggcatggtgactcatgcctg

SEQ ID NO: 25961 - DNA, 402 bp, Homo sapiens
agtgtttttttgcatccctgcccactttagaattaatacatgtaaaattgtcaagccttccagggtgcttttaaagctgacaagcccagttgtaaacttctaatcttatacataataattgattcagttgacttataaactgtgtgtgatctgttttgatgggatgataattttgatgctacttttatatctgacgttttaaatggaatattagaatgagttttaaagataatgagttccctcagagaaacaatagagttgtctatcagcatattattttaaaataacaaataaaaattgtactagataataggcataaggtatggacaaatctcaaagtcacctataatctgaagaaaaagagacaatacgtactcataaaagaaatgtagaataattagg

SEQ ID NO: 25962 - DNA, 150 bp, Homo sapiens
  misc_feature 9: n = A,T,C or G
actaagaanagtcacgaggtagaattaggggcccttgaaaatatgacaaactctgagggaaacaaagacaatgtggaaagaataacttaattttaattccattctccagagagatttgaggtgtatttaagatgaaaaacaggatactac

SEQ ID NO: 25963 - DNA, 116 bp, Homo sapiens
  misc_feature 17: n = A,T,C or G
atactttctgaatgacnaaccgtccctggactgtggaatgttccggcctgcatttctgcccaccccttccgttgtcacgagtgccgtgccgtgtaataaagtcccagtgctcatcc

SEQ ID NO: 25964 - DNA, 377 bp, Homo sapiens
ggctataaatcattgttagaaaattgtgacactgatttattttaatcccgacaatttggctagtaaactcccattttaaaaaatatgtcagtttggccgggcgcagtggctcacacctgtaatcccagcactataggaggctgaggtggccagatcacgaggtcaggagttcgagaccagcctgaccaacatggtgaaaccccgtctctactaaaaatacaaaaattagccaggtgtttgtggtgcacgcgtatagtcccagctacttgggaagctgaagcaggagaattgcttgaacctgggaggtggccggttgcggtgagccgagatcatgccattgcactccagcgtgggcaccaagagcgaaactccgtctc

SEQ ID NO: 25965 - DNA, 451 bp, Homo sapiens
ggtaacagatgaagaaaggctatggaagagacagattctggaggatgcagcattcaaggttctatcttggaagcagagactgtgccctcaccagatgctgaacctgctgagcaccctgatcttccacttcaccttcatcagaactactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaaaatatttactatttgatttcttcaagctccaaacgggcttgtgcttagctgtagaaacttgaatatatacaaatctacatggattagaattctta

SEQ ID NO: 25966 - DNA, 471 bp, Homo sapiens
  misc_feature 33: n = A,T,C or G
ggaaagaagatgaattatagctccggaagaatnaagatcttaagtgaagcctttctgttcagatgtgatctataaaaaatcataatttggggaaagtttaagcaaatctggctttgtagtcctgatgttataagtgactttgtgatcaaactgtcaggcttgggttcttgttatagaatgcttggtatagaaaaaccatgccatcattaatggctaacaacacgtagggacttcatgtcatgtcaaagatagctctttgcaagtgccttgattaaaccagaaaactgtcatcgtttaacccaaatatctgaatggtcatctggtaactcatgggttttttggcctcataagatggtccactctgtacacaggcattcctcctgcaataatgttgtatctttgagaccgttgtcagtgtacacaactcacatccttcatattgaaaggtgactcatttttctgcacactttt

SEQ ID NO: 25967 - DNA, 458 bp, Homo sapiens
ggaacgactttatctgtccagaatcagctgaaggaattgccagaaaaaatgcccaaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctctttcccttacggaattacatcttgatggcaacaaaatcagcagagttgatgcagctagcctgaaaggactgaataatttggctaagttgggatttgagtttcaacagcatctctgctgttgacaatggctctctggccaacacgcctcatctgagggagcttcacttggacaacaacaagcttaccaga

SEQ ID NO: 25968 - DNA, 463 bp, Homo sapiens
  misc_feature 45, 52, 54, 63, 64, 70, 81, 126, 148: n = A,T,C or G
cattgaataaacagggatctttcttaaaacttattaataataaanagttggngnagtaagtgnngaatanaattaataagnttaactgttctgtaaatggcttatatacgcatatatcaatatggntttatattttaaagtaagtgcnagctgtggttaaaagcagacacttttacactgctggtgggaatgtaaactagtacaaccactatggaaaacactatggagatgccttaaagaacttaaagtagaactaccattcaatccagcaatcccactattgggtatctacccaaagaaaaataagtcattatatagacacatgcacacgcatgtttatagcagcacaattcgcaattgcaaagatatggaaccaacctaagtgctcatcaaccaacgagtggataaagaaaacgtggtatgtatataccatggaatactactcagccataaaaaggaatga

SEQ ID NO: 25969 - DNA, 467 bp, Homo sapiens
  misc_feature 22: n = A,T,C or G
actttcacatcatcataaagtnaaaaaactgtaaatcaaaccttcctaagtcagtgaccccctgtacccttaaacaatgagataaacttccatcaagcatggcagtactctggctttgttctccgtttgaaaaaccgtcactttataggcttaatatatctattttacacattaagactgtaccttcaaactgtgttgttccatacagtagccctagtcatgtgtggctaaacttgaattaacaaaaattgaataaaatttaaaattcagttcctgaggtgcactaataacatttcaatggctccagagtaacatatggctggtggctactgtattagacaatacagaatggtttcatcatcacagaaagttctgctggacagtgctgagttggaaccaggtgttctttacacacagaccacttaaagactgaggttttatttatacacctgagttttccaagcact

SEQ ID NO: 25970 - DNA, 435 bp, Homo sapiens
attaacaattgctcagcccaattctcggatatagggattcaaaagacaggatacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaaga

SEQ ID NO: 25971 - DNA, 423 bp, Homo sapiens
atatatttcatggtgtcatatcttaaattatggccctatttctattttgtagtgtgctttttattagggattctgaatattctcattaacagtaacaaaaccaaccagcaaaaattttgaagtaatattgactctgaaaatgtccttcctgcagcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtaagccaaaaatgtccgatacacatgtttacattgttgagctacatttagtttagtgcttgaaatagggaactg

SEQ ID NO: 25972 - DNA, 305 bp, Homo sapiens
attagaaataatcatgtctcagcatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactg

SEQ ID NO: 25973 - DNA, 375 bp, Homo sapiens
  misc_feature 14, 22: n = A,T,C or G
gatactaaaagatncaactgtnacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcattagattctataaattcttacttgtctaagacaagtaaatctgtgttaaacaagtagtaataaaagttaat

SEQ ID NO: 25974 - DNA, 346 bp, Homo sapiens
  misc_feature 13, 48, 65: n = A,T,C or G
agagcataacttnacttaaattcttcattttagcagtgatgatatgcntaagtgctgtaaggctngtaactggggaaatattccacctgataatagcccagattctactgttttcccaaaaggcaatattaaggtagatagatgatcagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctg

SEQ ID NO: 25975 - DNA, 190 bp, Homo sapiens
acagggacttcgggcagaggagaacataactgaatcttgtcagtgacgtttgcctccagctgcctgacaaataagtcagcagcttatacccacagaagccagtgccagttgacgctggaagaatcaggcaaaaaagtgagaatgaccttcaaactaaatatttaaaataggacatactccccaatttagt

SEQ ID NO: 25976 - DNA, 401 bp, Homo sapiens
gagggttggggcgagtggaccgcgcctctaaagcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactgggatttggttactg

SEQ ID NO: 25977 - DNA, 456 bp, Homo sapiens
cctgttaggcgagagctgcgaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagattaagaagaagaaagggccaagtgatccagttccaaactttgggatatttttcttcaattttgaagaga

SEQ ID NO: 25978 - DNA, 100 bp, Homo sapiens
gaatacatgattgaaccactcagagatcttgtgactgacgcagctggtccaattgcattttcactgctgtgcagtatcggccttggatctggctttgatc

SEQ ID NO: 25979 - DNA, 117 bp, Homo sapiens
gaaaggcaagttagaatccgcttaaggatcatataatatcgtaccaggtaagaagagaggcgagaaagatgaaactgagtatgagtacagtgggagtgaagaagaagaggaggaagt

SEQ ID NO: 25980 - DNA, 246 bp, Homo sapiens
  misc_feature 2, 32: n = A,T,C or G
cncgggcagaacctgtttgtttcaattggccntttaagtttagtagtaaaagactggttaatgataaccaatgcatcgtaaaacccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 25981 - DNA, 373 bp, Homo sapiens
ctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagact

SEQ ID NO: 25982 - DNA, 469 bp, Homo sapiens
agactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcacctgacctgcctgtagccccagtgacagctaggatgtgcattctccagccatcaagagactgagtgaagttgttccttaagtcagaacagcagactcagctctgacattctgattcgaatg

SEQ ID NO: 25983 - DNA, 352 bp, Homo sapiens
gtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattc

SEQ ID NO: 25984 - DNA, 445 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaaga

SEQ ID NO: 25985 - DNA, 271 bp, Homo sapiens
  misc_feature 174, 199, 215: n = A,T,C or G
ggtagctcacacctgtaatcccagcactttgggaggctgaggcgggtggatcacgaggtcaggagatcgagaccacggtgaaaccccgtcactgctaaaaatacaaaaaaaaaattagccaggagcggtggcaggcgcctgtagtcccagctactcaggaggctgaggcagganaatggtgtgaacccgggaggcggancttgcagtgagccganatcgcgccactgcactccagcctgggcgacagagcaagactccgtcttaaaaaaaa

SEQ ID NO: 25986 - DNA, 484 bp, Homo sapiens
  misc_feature 120, 413: n = A,T,C or G
tatggccgggggtaggaagcctctctccctactgctgctacacaagaccctgagaactgacctgcaggacgaaaccatgaagagcctgatccttcttgccatcctggccgccttagcggnagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgcaatggtttatggatacaatgctgcctataatcgctactttcaggaagcgccgagggaccaaatgagactgagggaagaaaaaaaatctntttttttctggaggctggcccctgattttgtatccccctgtagcagcattactgaaatacataggcttata

SEQ ID NO: 25987 - DNA, 248 bp, Homo sapiens
  misc_feature 12, 28, 54, 67, 91, 102: n = A,T,C or G
cgccccccgggnctctccggcccctctnttggcccgggatgacgcagggagaanttgcgtcatttanagcctagttaacgcctttacctanacgcagacganaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttag

SEQ ID NO: 25988 - DNA, 453 bp, Homo sapiens
tcacccacagggaactataaacaaaaccctggttcataaataaaaactgttttctgtcgacctaattaattttcattttttctttctcaacaaaatatacaactaactatattttacagatctaaagttataatatgaaaagttatgattaagggagtgagggctgaataggaggaacacagaagatgtgtatggcagttaaaatattctgtatgatactgtaatggtagatacatttgtctatagaacatgcaacatcaagagtgaactgtgatgtaaactgtggatttgggatgataatgatgtgtcaatgaaggttcatcaattataacaaatggaccactctgatgggggaggttgacaatgggaaagtttgtgatgtgtggtatgtggggtatatgggaaattgctttaccttcctctcaattttgccctaaaaaaaaccaaagactc

SEQ ID NO: 25989 - DNA, 473 bp, Homo sapiens
gtatggtagtgttagaggtaggaagggaaggcagatggcccacacatgtattaaatattaataacagaagtggttgagagtatgtgcatgaattaacaggggtaaatgcatatgtatttgctaggatgatcaatgaaaaagatgaaactatacttcatgaaccttcaatttcaacttggtatataatctatataatgtctgttgttactggatccacccatgcctcacctcactgagatcttaaattatatcagtctttttttattgttaaaataacttccatgaaaaatctggagtagctgggctgtaatgatcataaagaactgtttctcaaatataatcctcaaatttgcaattcataaataactttagagaggcctcattttgtcatgccttttcactattaaaaatttgtatgatgaacctaattaggattacatcattttacatattcatgtgaaaaagatggcatg

SEQ ID NO: 25990 - DNA, 394 bp, Homo sapiens
aatatccaaaaagtactgtactgtagaaatgctctctgaaaaagtctatcgactgaccatgatcaatctagcatatgtatgttcagtgggctagccttggtcctcagggacagtgtgtgactctagtggtcttcctaaccagtctcttgcctaaagatatctgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaatatatatat

SEQ ID NO: 25991 - DNA, 460 bp, Homo sapiens
  misc_feature 16, 423: n = A,T,C or G
gtggagatcataatangggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgcaccgtgtctcaccaagacccagttgggaaagagcgtcatattgccaacaggttgggtttctctggcctacacctgattaatgggccctttatctttggtgtcccctaggagtgtccagntgttttattgctgtattttgttattgcagtacttaat

SEQ ID NO: 25992 - DNA, 202 bp, Homo sapiens
  misc_feature 7, 132, 166, 200: n = A,T,C or G
agcctgnccaacgtggagaaaccccgtctctactaaaaaaaaaatacagaattagccgggcgtggtgacaggtgcctgtggtcccggctgttgggggaggctgaggcgggagagtcgcttggacccgggagncggagggtgcggtgagccgagattgcgccatcgncctccagcctgggcgacaagagccaaactccctntc

SEQ ID NO: 25993 - DNA, 360 bp, Homo sapiens
agggaaagccgagggctgttttgttttaaattagtccgtcgattacttcacttgaaattctgctcttcaccaagaaaaacccaaacaggacacttttgaaaacaggactcagcatcgttttcaataggcttttcaggaccttcactgcattaaaacaatatttttgaaaatttagtacagtttagaaagagcacttattttgtttatatccattttttcttactaaattatagggattaactttgacaaatcatgctgctgttattttctacatttgtattttatccatagcacttattcacatttaggaaaagacataaaaactgaagaacattgatgagaaatctctgtgcaatattg

SEQ ID NO: 25994 - DNA, 314 bp, Homo sapiens
  misc_feature 25, 53, 126, 260: n = A,T,C or G
gagaattagctctttcccttttggnttgcaagcactgcctgtaaagccctcgnatgagaggccagcctgctagggaaatccaggaatctgcaacaaaaacgatgacagtctgaaatactctctggngccaacctccaaattctcgtctgtcacttcagacccccactagttgacagagcagcagaatttcaactccagtagacttgaatatgcctctgggcaaagaagcagagcttaacgaggaaagggatttaaagagnttttcttggggggtttgtcaaaactttttatttccctgtctggggggcagaggg

SEQ ID NO: 25995 - DNA, 464 bp, Homo sapiens
  misc_feature 14, 126, 391, 428: n = A,T,C or G
ctatttgatgagtncaactggcccagcaggcagggcatttgaagtcatggtcatcaaaaagaaatgattgttttttgaaaagctaaatgcttaaaatgcttctagagggaagtcgtggggcgtgtnctcattctctttaaaatcagggttgttgagtttgtttttaaacatttttataagttcatgagaaaaaatatataaattctaagaaccaacactgtattcccagaaacatgaccctcgctggtcttgggtccacatatcattggactctgggggacacaaagatgcctgtgacactttggtgttgcccgagttagtcaacaattattctgggaaaaagcagaattgaattcttctctagatgtcctaccagggttggccaagggcnccaaagcaggctaataaattcccacaggatccagacnccaggcaaaattgctctaagaagccagttactgtca

SEQ ID NO: 25996 - DNA, 335 bp, Homo sapiens
gaggaggagcctgggaatagtgctgcaggctccaccatataagccaggacttcaccttcatgggccacatactctgacacgagcagcagatacccaaacacatggttatgagatggcattacagtgagtaccaaattaaagttattaccaaatgattaaatgttaaagacatgtatgcattacataagagacagtgggagcctgtagtcccaaccactcagaaggctgaggcaggagaattcctaagttccggaattcaaggctgtagtgtgctataatcatgcttgtgaacagccactgtactgtagcctgggaaacacagggagaccctgtac

SEQ ID NO: 25997 - DNA, 447 bp, Homo sapiens
gaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgtagccgctattaaaggttcgtttgttcaacgattaaagtcctacgtgatctgagttcagaccggagtaatccaggtcggtttctatctacttcaaattcctccctgtacgaaaggacaagagaaataaggcctactttcacaaagcgcctt

SEQ ID NO: 25998 - DNA, 135 bp, Homo sapiens
  misc_feature 118: n = A,T,C or G
gtatttaaagagaatttttctttaaaagccagttactttctcatatacagcattttaggaagcatgattttttttttctatcatctattcctccaagcatgtttaattgaagaaagtnttaatatctctttagat

SEQ ID NO: 25999 - DNA, 428 bp, Homo sapiens
  misc_feature 281, 284, 286, 354, 365, 372, 395, 424: n = A,T,C or G
taagaagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccganggngnttaaaagaccttgaaatccatgacgcagggagaattgcgtcattttaaagcctagttaccgcattttnctaaacgcggncgaaatnggaagatttaattgggggggggnagggatgaaccaattttggagaagatagnaagt

SEQ ID NO: 26000 - DNA, 125 bp, Homo sapiens
ggaaatcctagctgagcaattgggcaagaaaaagaaggtaaaaagcatcaaaattggaaaggggtaaaattatctctttacatatgacaaaattttttatatagaaaaccctaaactttccatgt

SEQ ID NO: 26001 - DNA, 473 bp, Homo sapiens
atatcaacacatgaaattaccacgtttatgccaggataatgttgcattaaattaatgcatcataatatatgtcacctggctcctcatgatgggcatgtcagtcttttccagtttttgatacaaataacactgcgatgaagtgactcatgcattcatttttgttcactgatttgatgggccctttagtaaaaattcgaccatatgttcttgctgggtcaaggttatgcagttattaatacatgttgctaaactgtcttcaaagaagttgtaccaatttacattctgcttccacattccttagcaatacaaatctagtttttgcaatgaaagttaccgggacagtaacatttattctttagagtttcagttttatgcagtctatatattaggtgctaccagaaagattaacaactataaatactgttctgattgtgatctcctcaaggtgaaatagttaaattattcttttgaga

SEQ ID NO: 26002 - DNA, 479 bp, Homo sapiens
attggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagt

SEQ ID NO: 26003 - DNA, 347 bp, Homo sapiens
gggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggtaccgggacttcccagacgtgatctcaggagcgtatataattgaagtaattcctgataccccagcagaagctggtggtctcaaggaaaacgacgtcataatcagcatcaatggacagtccgtggtct

SEQ ID NO: 26004 - DNA, 438 bp, Homo sapiens
  misc_feature 4: n = A,T,C or G
tctnttggccggggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgatt

SEQ ID NO: 26005 - DNA, 473 bp, Homo sapiens
gaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgatt

SEQ ID NO: 26006 - DNA, 472 bp, Homo sapiens
  misc_feature 10, 18: n = A,T,C or G
attgacaagnacgggagnagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttggagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccacttcgactttccaacatttttgttattggcaagggcaacaaaccatggatttctcttccccgaggaaagggtatccgcctcacca

SEQ ID NO: 26007 - DNA, 469 bp, Homo sapiens
  misc_feature 193: n = A,T,C or G
ggtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcacaattattctttcaaaaatgatgcttatgagtactgcaacctgcnttctatagattgacaagaaaggtttttgccaatccagaagactgtgtagcatttggcaaaggagaaaatgccaagaagtatcttcgaacagatgacagagtagaacgtgtacgcagagcccacccgaatgaccttgaaaatattattccatttcttggaattggcctcctgtattccttgagtggtcccgacccctctacagccatcctgcacttcagactatttgtcggagcacggatctaccacaccattgcatatttgacaccccttccccag

SEQ ID NO: 26008 - DNA, 358 bp, Homo sapiens
  misc_feature 17, 75, 150, 322: n = A,T,C or G
tacaacaggagagaganggacatggctcattgtagcacaatcctattactcttcctctaacatttttgaggaagntttgtctaattatcaatattgaggatcagggctcctaggctcagtggtagctctggcttagacaccacctggagngatcacctcttggggaccctgcctatcccacttcacaggtgaggcatggcaattctggaagctgattaaaacacacataaaccaaaaccaaacaacaggcccttgggtgaaaggagctatataattgtgaagtattaagcctaccgtatttcagccatgataagaacagagngcctgcattcccaggaaaatacgaaaatcccatgag

SEQ ID NO: 26009 - DNA, 474 bp, Homo sapiens
  misc_feature 90: n = A,T,C or G
agtgaaacaacatataaagtacctagcccatcgtagtactcaataaatgtagttcacccctgtagacataactggttttggctgcttgtnccctataagaaagcatcaggggtgtttttgctttttacttatccacatattctcatcacaattctcataggtagaaaaatccaccaaaaaactgaaaataatttgaattatccttcttttggtgtgcttattttagaaataagggcaaggctatgaaactagtagtagcccataaacctatgaaaggatgcccaacctcattagttaatctcaagacaaagcaaattaagaccataatgagataaaacattagactggcaaaaatagaaaacatctgatgatcctgtgttggctagaatttagatcaactaaaactcttactctttctggtgagagtataaatcagtacaactactttggaaaataatttggtactatcttgta

SEQ ID NO: 26010 - DNA, 369 bp, Homo sapiens
gagcctacactatttttataaacatttttttccactagtttagagaaatgttttaaaaggaaacttgtctttgagttcaacttggattgtaatttgaatgtagaagaaaggctgcataatccaatcaaagcatatatttcattaatgttttttgtacattaatacagggtatctcagtatagtagcttattatattgagttattatttaaaaccccacataatacattattgataccctcaaccttaattcagtacttcatacttgtgaaacaccccataatgagtagttgaattttgggattttatggatcatccatatcaatagttatataacttgtggggttttttagtttttttgttttgtttgc

SEQ ID NO: 26011 - DNA, 390 bp, Homo sapiens
attgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttg

SEQ ID NO: 26012 - DNA, 485 bp, Homo sapiens
  misc_feature 435, 458: n = A,T,C or G
tatggccgggtcttctggcatttgtagaatctctggccctgggtgtgtcttttcctgtagctgttacagatttcttaagcagatttcttaagcagatggacatgtccagattcatgcctaaatatccagttgataactggaaaatgccggttcacggttctttagtaaagattaataagggatccccatgtgctggggagtgtgcttccatttgagtggggatatcagaagaaaaagaggggcttgtgtagtaaaccttactttgccaattcagctgtagagcccaaattgttacaagatgcaaagatgtactccactttttgaccaagcatcagcacctttggcttaccatccagtccttacttctgtgactgtaagggccccaccagtgtcagcagacttgtttgtgctttgggggaactctcttctcagctncctttgccagtcccaagcctggnggatctgcatctcacgcccactgcaca

SEQ ID NO: 26013 - DNA, 410 bp, Homo sapiens
  misc_feature 52, 405, 407, 408: n = A,T,C or G
ggggtttctgtggaagcctagctgggagctagaactctcacccttgctcagnagtaacgaggagccctccactctgcagtgtcagtggaggctgagtacggaacctggactcctacccctacctagaagtaatgaagtagtgctcctcttctgttggagcagtgtcagagaaagccagcttaaacaaagggtttgaataagatccagggtcttaaaacataatgccccaaatgtgcagattttaatgaaaaatcacttgttatactaagaatgaggaagatctcaaactgaatgaaaaaagagaatcaaatcaacagatgtcaaaactgagatgatagagatgttagattttaaagaagtcctcataaaattgcttcaataagcaattgcaggtatgctttgaancnnac

SEQ ID NO: 26014 - DNA, 452 bp, Homo sapiens
gttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcacc

SEQ ID NO: 26015 - DNA, 465 bp, Homo sapiens
  misc_feature 57, 85, 88, 134, 141, 159, 199, 212, 214, 256, 265, 297,314, 332, 348, 376, 389, 423, 437, 456: n = A,T,C or G
aggcgtgagccccgccctggccaaaactgtattctttatgatagtttcagtcttctngctcccatgtctcattttctttacaaanggncactggattcgagtctttcttgtgatatggaagacctttatcttanaatgttnaattttttcaaatacttngtaacaagccacaaaattttaacagcatttaatctttgcnccaacaaaacctntnttaaaaacaaaagcaatatgtgggagtattttactttatgtnttatgggangaaaaatgaacgttaataattacatagggatncatgtcatcatgaaatnctacatttaaatagagantgggcaataacatcgngatggaaggcttgtaaaatgtagccagngaactaatctganggagatatttttcaattaaaaaagtttttttatncctgatagaaaatnggctgcttatttagaagcncagttcatg

SEQ ID NO: 26016 - DNA, 460 bp, Homo sapiens
  misc_feature 8, 114, 157, 440: n = A,T,C or G
gttaaagnagaaccaaaaaaaaggagaagaatttttgtttttaaaaagaatggtctggctgtgtcggcccaggctggagtgcagtggtgctatctcggctcctggctcaggccntccccagagaccttcctatatttcagaccggggcaagagcagngggagatgattaatgagagagcagaaactccagatgggttgaaaaggacgccaaaagcacaaaagcaaggccctagcctcacttctaatttgaaaccctgcaaagtgttcctatgaccacatgggatagaaagcaagaagaccgagggatacacaatgtttggcacagagatgatctgagattacagacacaaacaccccacagaattttcctttgattcccagatgtcgtaagagggacatcacttgagaaccaatgggacttgtgatggggtcattatggngaaagataggggttaaagag

SEQ ID NO: 26017 - DNA, 250 bp, Homo sapiens
  misc_feature 9, 10, 27, 175, 224, 238: n = A,T,C or G
cttccggcnnttttggccggggcgggncccgagcgtttactttgaaaaaattagagtgttcaaagcaggcccgagccgcctggataccgcagctaggaataatggaataggaccgcggttctattttgttggttttcggaactgaggccatgattaagagggacggccgggggcnttcgtattgcgccgttagaggtgaaattcttggaccggcgcaagacggnccagagcgaaagcntttgccaagaat

SEQ ID NO: 26018 - DNA, 430 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattg

SEQ ID NO: 26019 - DNA, 472 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgata

SEQ ID NO: 26020 - DNA, 460 bp, Homo sapiens
  misc_feature 4, 21, 169, 353, 412: n = A,T,C or G
gaancacggggtaattcggcnattatggccgagggaaagcgaattggcaccaaagcagcagcttgtattgccgcagttctagcttcaccttcacgatgtttcccttggtcaaaagcgcactaaatcgtctccaagttcgaagcattcagcaaacaatggcaaggcagancccccagaaacgtacacctgattttcatgacaaatacggtaatgctgtattagctagtggagccacttttctgtattgttacatggacatatgtagcaacacaagtcggaatagaatggaacctgtcccctgtcggcagagttaccccaaaggaatggaggaatcagtaatcatcccagctggngtaataatgaattgtttaaaaaacagctcataattgatgccaaattaaagcactgtgtncccattaagatatggcattattgaagaaataaagtacatttgaaacct

SEQ ID NO: 26021 - DNA, 129 bp, Homo sapiens
  misc_feature 56: n = A,T,C or G
gcccggggtattcggccttatggcggggattaaagtatgagatagagttgagaganaattaattatcccctcttacacacaaacacacatactcccacatacttacccacatgtacacggagtatctgg

SEQ ID NO: 26022 - DNA, 319 bp, Homo sapiens
  misc_feature 147, 191, 249: n = A,T,C or G
attacacttctttaaaaaaaaatttttttttggccaggctcagtggctcacacctgtaatcgcagcactttgggaggccgaggcaggtggatcacctgaggtcaggagtttgagaccaccctggccaacatggggaaaccgcgtctntactaaaaacacaaaaaaacattagctgggtgtggtggcgggtnccttgtaatcccaactacttgggaggctgaggatgagaatcgctcgaacctgggaggnggagattgcagtaagcagaggtggcaccacttgtactgcagcctgggcgacaagagcgaaagtccatctc

SEQ ID NO: 26023 - DNA, 142 bp, Homo sapiens
  misc_feature 20, 138: n = A,T,C or G
tattgaatggtgattgcctnctttatttcagaaggaccagtgctttgatttttattatgctatgttataactgaacccaaataaatacaagttcaaatttatgtagactgtataagattataataaaacatgtctgangtca

SEQ ID NO: 26024 - DNA, 487 bp, Homo sapiens
  misc_feature 2, 9, 61, 125, 206: n = A,T,C or G
tntccggcnatctattggccgggggaatgtggtcttttaccattcactaaaatgaaaaccntacttaataagttgtatatagtattgtaaagataattgcctgttttaggtatttcaaaattggngactttggtttagcatttagaaaatattgttcataaggttttttaactttttatttagaaaatttaaaacacttggccggngctggccgtgttggctcatgcctgtaatcctagcactttgggaggccaaggcgggcggatcacctgaggtcaggagttcgagaccagcctggccaacatgatgaaatcctgtttctattaaaagtataaaaattagccaggcattgtggcgcacacctgtaatcccagctactcgggaggctgaggccgggagaattgcttgaacctgggaggcagaggttgcagtgagccaatatcgtgccactgccctccaggctgggcaacagagcaagactccatct

SEQ ID NO: 26025 - DNA, 470 bp, Homo sapiens
  misc_feature 10, 437, 447: n = A,T,C or G
atttctgaangaacagaagtacaactcggaaggataatcacccagaacatggatgcaaagttttaccctggccagctcagggtaaaactttctctagcctgagattttggtactgtacagttaaatcattcacatttttaatgagagaaggggacggcagcagggaaaacagttgtagaaattttagttgtatgaatttgaaatatttttcaactatacatagtgagggagatgtttttctttattttattaagaaactatttacatttaagttccagaggagttgaaggagtgtgatttattttttaacctaatatgcttattgcattttctttatgatcactattcctggatgttatatcatttcattttggtttctgttaaaagaagaagtaacattcccacagctttcttctatgttgtttcttgattgctgnatttctttgntttggggatgatttgatttatac

SEQ ID NO: 26026 - DNA, 109 bp, Homo sapiens
  misc_feature 55, 85, 104: n = A,T,C or G
gaggtaggcattgaggcagccagcgcaggggcttctgctgaggggcaggcggagnttgaggaaaccgcagataagtttttttctntttgaaagatagagattantccac

SEQ ID NO: 26027 - DNA, 404 bp, Homo sapiens
  misc_feature 98, 282: n = A,T,C or G
gagtggcaactttcaggatgacaaaaaccaaagtctcttctgctgggaaatcccagtacagatcgtttctcatctctaagtgcctcattgagttcggngcatctggccaatgagtctgctgagactcttgacagcacccccagctctgtggtttcgacaacagtgacttgctctccaatggtatccagtgattcgttgaagaggaggtgctctgtagcagaaactgagctccgggtggctggttctcagtggttgtctcatgtctctttttctgtcttaggnggtttcattaaatgcagcacttggttagcagatgtttaattttttttttaacaacattaacttgtggcctctttctacacctggaaatttactcttgaataaataaaaactcgtttgtcttg

SEQ ID NO: 26028 - DNA, 271 bp, Homo sapiens
gttgatgtaataccctgatgcgttttagaggacttggcataaaatgaaagattggcaaaggcccttgaggggcttggggatgacagtatggaactgtctgcattggaccctaaactggactagaagaggcatcttcaaggttcatacgttgtccagctgtaagttcatttgagtagcagacctaacaaatatttgaggtcaggaaccctaccatgttaaaacaaacaaaaacttaccatgttaataaaagtattcatttgcttgaaaagac

SEQ ID NO: 26029 - DNA, 397 bp, Homo sapiens
  misc_feature 19, 26, 144, 161: n = A,T,C or G
ctcttaaaaaaacatcagnataattnacttagaagaagaaacaatgtaaatgtgatgtatgtggcaaggtctttaatcagaagcgataccttgcctgccatcgtagatgtcacactggtgagaaaccttacaagtgtaatgagngtggcaagacctttggncacaattcatccctcttcattcacaaagcgcttcatactggagagaaaccttatgaatgtgaagaatgtgacaaagttttcagtcgcaaatcacaccttgaaagacataagaggattcatactggagagaaaccatacaaatgtaaggtttgtgatgaggctttcgcatataattcatatctggcaaaacatactatacttcacactggagagaaaccttacacatgtaatgaatg

SEQ ID NO: 26030 - DNA, 397 bp, Homo sapiens
  misc_feature 24, 198, 201: n = A,T,C or G
tgttcttggaatttaacatgcttnacaaggtatgaagttctggtttttaattctgatttatagaattatgtattgatcttccaaattgaaaacacaaccagtatattctatgatttcagtgtttgggatgttacagggtcagtttttttgaaccttcagttatgacatctgagacagattgagggtcagtattaatgnggntctttatttactagtaaaaccaagtattcagtactaatgacttcagagcattaaatgagacttgaggttctttcttccctaatgtaagacgataggtatgggaatatataattaccaacctacaccctctccacccaagctttgaaagagcccagtttcccacattttgagtctcatatttatgttcagtaccttg

SEQ ID NO: 26031 - DNA, 311 bp, Homo sapiens
  misc_feature 6, 10, 17, 18, 19, 20, 104, 153: n = A,T,C or G
gtgccnaganccggagnnnnggtccagcctctgatggctcggagatgatggaccgtggaagggaagcgtctgtggggagtgagcgcttagatggccagcagctnctccttctgggaagctcgaccttggcaacagaacagccctctagcagancgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttt

SEQ ID NO: 26032 - DNA, 415 bp, Homo sapiens
  misc_feature 1: n = A,T,C or G
nacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacat

SEQ ID NO: 26033 - DNA, 287 bp, Homo sapiens
accaagaaagaaacatattctgggtcttaaagcaaacttgtacaaatttatacaaaatcatattatgtgcaataacagtattacaacaaaaatcaataaaaaagatacttggaaaaccccaaatatttggaaatttaaagatatacttacttctaaataagtcttaaggggaatttgaaactattttgaattaaatgaaaatgcaacatatcataatttgtgggacacagcaattagagggatatttatagcactgaatgcatatattagaaataaagatcaagcgg

SEQ ID NO: 26034 - DNA, 376 bp, Homo sapiens
  misc_feature 3, 10: n = A,T,C or G
tgnccggggnaattcggctttatggccggatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagattctcca

SEQ ID NO: 26035 - DNA, 500 bp, Homo sapiens
  misc_feature 12, 17: n = A,T,C or G
gaccagggaaantcggntcttatggcggggaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcaggcccagtccttctctagaagatgcaaaactcagaagaccaatggtcatagaaatcatagaaaaaaattttgactatcttagaaaagaaatgacacaaaatatatatcaaatggcgacattcggaacaacagctggtttctctggaatattctcaaacttcctgttcagacgctgcttcaaggttaaacatgatgctttgaagacatatgcatcattggctacacttccatttttgtctactgttgttactgacaagcttttt

SEQ ID NO: 26036 - DNA, 472 bp, Homo sapiens
  misc_feature 16, 96, 100, 401: n = A,T,C or G
ggtaaaagaaaaaagnatcaaattgaatatatcttttaagaaattcaaaactagtgtattcacttaccctagttcattataaaaaatatctaggcnttgnggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaatagggtagagatacaacaaatgaatataacactataacacttcatattttccaaatcttaatttggatttaaggaagaaatcaataaatataaaatataagcncatatttattatatatctaaggtatacaaatctgtctacatgaagtttacagattggtaaatatcacctgc

SEQ ID NO: 26037 - DNA, 327 bp, Homo sapiens
  misc_feature 23, 24, 313: n = A,T,C or G
atttttgccccgggtattcggcnnttatggccgaggaggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacgtgacggaggttgagatgaancttcttcatggagt

SEQ ID NO: 26038 - DNA, 238 bp, Homo sapiens
  misc_feature 5: n = A,T,C or G
caagnaaatactgttggaatcttatccatagtgacttaatgatatttaatttatttaattaagtacaaccctagaaaaatgttttttgttttataaatgataacacaagtacttcactgaaacaggtcatgaatcaagaattattcgaaacgtgctaattaaatttcattgccggatactcagagctttaaagagccaagaatgcaaaatctggagatgcctttccctacactattat

SEQ ID NO: 26039 - DNA, 116 bp, Homo sapiens
gggtgacggggaatcagggttcgattccggagaggagcctgagaaacggctaccacatccaaggaaggcagcaggcgcgcaaattacccactcccgacccggggaggtagtgaccg

SEQ ID NO: 26040 - DNA, 185 bp, Homo sapiens
  misc_feature 2: n = A,T,C or G
anggcgaaaccccgtctctactaaaaatacaaaaattagctgggtgtggtggcatgtgcctgtagtcccagctgctcgggaggctgaggcaccgagaattgcttgaactctggaggcggaggttgcagtgagctgagatggcaccactgcattccagcgtaggtgacagagtgagactctgtctc

SEQ ID NO: 26041 - DNA, 269 bp, Homo sapiens
gactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttg

SEQ ID NO: 26042 - DNA, 468 bp, Homo sapiens
  misc_feature 24: n = A,T,C or G
gacagcaatagtgcagaatccagnaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctcagagtccagatctgaacgatgccgtgtccagtttgcgaagtcctattcccctcctcctgtcgtgtgcctttgttcaggtggggatgtatttcatgtagaaggtggaagaaggctgctatgactctttggatgggagtctggc

SEQ ID NO: 26043 - DNA, 491 bp, Homo sapiens
  misc_feature 1: n = A,T,C or G
nttgattaaaagaatatctggaatgtagccccactctttgagtgggattcatttcttactgcttatgaactttcaatttagtagtcagaaaccatggatttattttactgcacaatgtgaagtttacattttattaacacttgagtagtctgatttagagactagttacttctattttttaaaataatggagtaacaaattacagaatagctaaataattttttaaaaatattttacagttgtaaaaaatatccatcagaaaaatgacacacaaaacaaaatatctggacctttacagaagacgtttgctgacccccactttaaaggattggaacagtcttctagaattgaggaatatttattaaaatacctgtaaagaaaatagtgaatcactgtagcaatggctttgattcagaccttaaaatcacataagaagaattacaacatgtattggatttttaagtggcaggtattgtaactgtttttttgtg

SEQ ID NO: 26044 - DNA, 474 bp, Homo sapiens
  misc_feature 10, 32, 142, 164: n = A,T,C or G
aacagcaagnaatatacatggccctcaggccngctgcctgttttaataaagttttattggagcacatccatggatctatggggctttcctgctacaatggtagagttgaatggttgctatagagaccgtatggtttgcaaancctaaaatatttttcatctggncctttatagcaaaagtgaacccagttttagaacattcactttacaaattaagatacagtggatgctgccttaactgacctccacttaactgatttacaatcagcactttcttgtacccctgtacaacttattgactgatgtccactgcaaatggaaagcctttgagctactttttaatgcctgtacatttctccttccatcacagaaactgtacagtttctaagaggaagctgtgttcattcctaaatatgtttacgccatttgttcttgttcttgtagttacgcaatttaattaaatatgatgttgaga

SEQ ID NO: 26045 - DNA, 499 bp, Homo sapiens
  misc_feature 3, 178, 214, 342: n = A,T,C or G
atngcggggtagcccatccaacttaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagnggggggggagtctcacagtgcctttggaagggcccngaacttgccttaaatcttcctcaaccaaataagtattttattagtgcttgagagaatctgaatgtaggatgggtccaactgcacaaaaggaaaagatttttaccactttttttatatagatataaagngaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggcagctttagg

SEQ ID NO: 26046 - DNA, 129 bp, Homo sapiens
gtaaacaagtaaacacatttgaaatataggacttatacatataactatttgtccataacaaaatttacaggatagatagcattgagaattttgtaaaattaataagatttcaaataaatgagcacctat

SEQ ID NO: 26047 - DNA, 454 bp, Homo sapiens
  misc_feature 101, 142, 433, 438, 453: n = A,T,C or G
tattcggccttatggcgggtatagacacgggggtctatgttgcccaggttggtcttgaactcctagcctcgggggatcctcctgcctcagcctcccaatgngctgggattacaggaatgagccaccatgcccagcccaagangtagagtttcttttatactgactttggcctaaaaaaacagattttcatggaggaaaaaaaaacctagatttttaataagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttccctactttataaacactaggtaaagtaatctcacaaagctgccnaaagnaacacatcccaggcng

SEQ ID NO: 26048 - DNA, 135 bp, Homo sapiens
  misc_feature 3, 81: n = A,T,C or G
ggnccggggtattcggccttatggcgggtattcttgtacaagttttttgtggacatatgttttcatttcttttggggaaangaaaaaggggaatgctagtttaactttataagggactgctaattttccaaaggg

SEQ ID NO: 26049 - DNA, 138 bp, Homo sapiens
  misc_feature 12, 119, 135: n = A,T,C or G
atcactctgatnaatttcttgtaaaagtgctatgggaattatttttcctgtgaatattaatgattttactactgcctccgaagttttaaaaaaggttctgtagacagaaaacagttgtngcaacccaaaaaccanccc

SEQ ID NO: 26050 - DNA, 114 bp, Homo sapiens
  misc_feature 5, 63, 83, 107, 109: n = A,T,C or G
gcctnacaaagaacctgatacactggaatgtttttctctggaatcctctttctactctggatnaaaatttttccccacttcangattatattcaaaataaacaactncntcttt

SEQ ID NO: 26051 - DNA, 120 bp, Homo sapiens
  misc_feature 51, 69, 73, 77, 79, 81, 85, 89, 100, 119: n = A,T,C or G
aatattgttcataaaatcctaattcactttaaacttatcattaacgatgcnctttttaactcattaaangaancgcntncncaangctnctgataatttngtatgttaaagtcctagtnc

SEQ ID NO: 26052 - DNA, 466 bp, Homo sapiens
  misc_feature 52, 103, 219, 274, 323, 326, 344: n = A,T,C or G
gaggcattgaggcagccagcgcaggggcttctgctgagggggcaggcggagnttgaggaaaccgcagataagtttttttctctttgaaagatagagattaatncaactacttaaaaaatatagtcaataggttactaagatattgcttagcgttaagtttttaacgtaattttaatagcttaagattttaagagaaaatatgaagacttagaagagtancatgaggaaggaaaagataaaaggtttctaaaacatgacggaggttgagatgaancttcttcatggagtaaaaaatgtatttaaaagaaaattgagagaaaggnctncagagccccgaattaatnccaatagaagggcaatgcttttagattaaaatgaaggtgacttaaacagcttaaagtttagtttaaaagttgtaggtgattaaaataatttgaaggcgatcttttaaaaagagattaaaccg

SEQ ID NO: 26053 - DNA, 154 bp, Homo sapiens
  misc_feature 108: n = A,T,C or G
atctgtcccgctgcgtgttttcctcttgatcgggaactcctgcttctccttgcctcgaaatggaccccaactgctcctgctcgcctgttggctcctgtgcctgtgccnggctcctgaaatgcaaagagtgcaaatgcccctcctgcaagaagag

SEQ ID NO: 26054 - DNA, 399 bp, Homo sapiens
  misc_feature 3, 57: n = A,T,C or G
ganagcaatagtgcagaatccagaatggatgtcctctttgtagccatctttgctgtncccttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctgtggaagaaggctgctatgactctttggatgggagtctggcaagaggaaattggaagataaaataaataataagtg

SEQ ID NO: 26055 - DNA, 273 bp, Homo sapiens
  misc_feature 1, 158, 168, 208, 243, 262: n = A,T,C or G
nagagaaaataaacaaataacatacaaaggagctccaatacatctagccgcatacttatcagtggaaaccttacaggccaggagagagtggcatggcgtacttaaagtgctgaaggaaaacaaaacttttatcctagaatgtatatccagtaaaaatntcctccaatntgaaggagaattaagactttccagacaacaaagctggggntttggtaaccctaacctgcctccagaaatgctaanggggtcctcagttttaagnaaggggttttt

SEQ ID NO: 26056 - DNA, 449 bp, Homo sapiens
  misc_feature 12: n = A,T,C or G
gaatgcttcgcntcagtttgaacattgaccctgatgcaaaggtggaagaagagcctgaagaagaacctgaagagacagcagaagacacaacagaagacacagagcaagacgaagatgaagaaatggatgtgggaacagatggagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaatttttttaacattcctcatgaatgtaaatttgtactatttaactgactattcttgatgtaaaatcttgtcatgtgtataaaaataaaaaagatccc

SEQ ID NO: 26057 - DNA, 389 bp, Homo sapiens
gataatattttgggtatattcattaaaacaaaatatatttccgaaactaattcatcatgtttcattttattctttttaatgtagctaatagaaaattgaaaattatatatgctttcattctctttctattggatggcactggactagaacaagcactgtgctcctggcttgaccccacgccagaaggagctagaaggatgagtggctggtgagacatgagtggtgtgtgccgtagatgcagcactctctgcagcctctgtctgcctctggtttgaatggcctcttccaatctgctgtgttgtgttttgctcagctgattctgagtggtgggaagattttattgcactctgacttagaattgcgccaatttagaatttgattctcatctg

SEQ ID NO: 26058 - DNA, 102 bp, Homo sapiens
  misc_feature 4, 6, 28, 31: n = A,T,C or G
tctntngcccggggagcaaaggcggcgncanctaatgaagaaatgaataataaattttgacactgaaaaacattttattaataaaggaatattgacatgagt

SEQ ID NO: 26059 - DNA, 487 bp, Homo sapiens
  misc_feature 6: n = A,T,C or G
gaagtnctgtggtgctttgtttgtgtttcagaaagcagtacttggagatacttctgaaattgcaggaaaatgttcatccccataggaagtggttacagagagcaactaaacttggcagtttaaaaggagactatactaagcacatctcaattataaatggatgaaaataatatttatcatagactttttaaggacttattcctttttacattatttctgaaaagatatagctggccccaatcagcatccattcctgttgtctcttagaggtcatggctaagaggtgagcctggtagatttgcccaagctggtaatgagagatacagacctgttgaaaggcacaggctcccattgtcttcttaacgccttatagaaacacttctggttcatctcaagcatcgtttgggtgactgttctaattcctcgcctcatcttcactgtgggagggcattacagctccctcagaactcctgtagcactttatctg

SEQ ID NO: 26060 - DNA, 152 bp, Homo sapiens
  misc_feature 7, 30: n = A,T,C or G
aaacatnagctgggcatggtagcacatgcntatagtcccagctacttgtgaggctaaggcaagagaattgcttggacccgggaggcagaggttgcagtgagctgagatcatgccactgcattccacattccagcctggtaacacagcaagac

SEQ ID NO: 26061 - DNA, 346 bp, Homo sapiens
attcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttttaccacgcttttgtgatggagtgctgttttgttatataatttagacttggattctttccattttgcatttgtttatgtaatttcagg

SEQ ID NO: 26062 - DNA, 489 bp, Homo sapiens
  misc_feature 6: n = A,T,C or G
agtgcnttgaaaattaaaggaatttttattattatggtaaccttatgagtaaaaataagttactttaattgctttatttcgttagttgtcattttattttgtactatgctggtaaactaattgtggcttagaatagttttatgttcactcctgataactgagaaacagaactaaagttttccttacattgctaaatggataaacctcatattcaataaactagtaaatgtagccacttgactgattgcgtaaatcgtgttaaaacattctaaaatgttgtaaataatttaatgtgaatactgttaaacagaaaataattgcttataaaagtctaacttcacccagttaccaagtcttggccaaattttatcttctgcctatagtttttactagcctttttaaactataatagtgagtgatcattactttatattctcgtaagttagaaatacttgaatgccaaattaattttgttttaagaaagcttat

SEQ ID NO: 26063 - DNA, 490 bp, Homo sapiens
  misc_feature 2, 32, 213: n = A,T,C or G
gnctccctgcgatcgaaggggacttgagattnaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacaggagagaggaagaagctnttcagttggatggattaaatgcatcacaaataagagaacttagagagaagtcggaaaagtttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggacctaacagtcaaaattaagtgtgataaggagaagaacctgctgcatgtcac

SEQ ID NO: 26064 - DNA, 339 bp, Homo sapiens
tatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaag

SEQ ID NO: 26065 - DNA, 335 bp, Homo sapiens
  misc_feature 5: n = A,T,C or G
gaaantctagcagctgaacctccaccatatgtgcaggagagtcatttcaagttgtcgtgagaggaaacggcttccgacatgcccgcaacgtggacagggtcccctgcagcttcaagatcaatgactcggtcacactcaatgagaagcccttttctgtggaagatacttatttactgtgtccagcgcctatcctaaaagaagttggcgtgaaagctgcactccaggtcagcatgaacgatggggcctctcttttatctccagttctgacatcatcaccaccacacactgtagcctccacaaaattgcatcaggccccacaacagctgcttgcatgg

SEQ ID NO: 26066 - DNA, 186 bp, Homo sapiens
cccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaattt

SEQ ID NO: 26067 - DNA, 112 bp, Homo sapiens
gtatagtaccaggtcatgtccatcccttggtacatatatgcatttgcttttaaaccatttcttttgtttaaataaataaataagtaaataaagctagttctattgaaatgcg

SEQ ID NO: 26068 - DNA, 153 bp, Homo sapiens
  misc_feature 6, 37, 46: n = A,T,C or G
gatgtnacagccattgtgagactgatgcacaaactgnaacttggtnaatttaagcacttctgttttcgcgaatttgcttgtttgtttcttgcatgcctttacttactttgtcccatgctactgattggcacgtggcccccacaatggcacaat

SEQ ID NO: 26069 - DNA, 353 bp, Homo sapiens
  misc_feature 3, 19, 30, 33, 36: n = A,T,C or G
tcnggcctttgggtcagcnttcatattatntgngtngcctctaaaaccccgtccaaaaatctagtttaaaattgccttatcctggcaatacctccagagatctgccagaaggaaactcagattctttctgcactttatacacagctttcaaaaaattctcatacggttccaaggaagatggttttcacaagacacacaaataagccatcttgagtaacttcatagaatgaacaaactacagaatcaggtctgcaaacactgtagatattgaaattataaggtactgaaaaaagtattttaatatacattattcctaatgaatatgttgaagaatatttttaaaagaaaatagg

SEQ ID NO: 26070 - DNA, 375 bp, Homo sapiens
tacaaccttcatgaatgcagatattctagcatattgtcagaaggaaggatggtgcaaattagctttttatcttctagcatttttttactacctatatggcatgatctatgttttggtgagctcttagaacaacacatagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatggttacctctggtg

SEQ ID NO: 26071 - DNA, 453 bp, Homo sapiens
gccttttggctctctgaccgcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttact

SEQ ID NO: 26072 - DNA, 417 bp, Homo sapiens
gatgcactggaaatgatctgtaacttagaatctgggggtgatgaaaaaagcgctcttgttttatgtactgcgtttttgtcacgtcagctccaacaaggagatatgtactgcgcttgggaacttactctcttttggagtaaattacaacaaagagtagaaccatctatacaagtgtaccttgagaggtgtccgtcaactttctttgttaacgaaaacagtatatcacattttcttcctgattaaagttattaattcagaggtaagaataatcagaatatttttaaggttaaaatgtgtacattatcattaataaaagactataacttttatgattttggctcccttttcagtgatttttaaattttttcagttagtcctttgaacattttcttgttagtcctttaagatatttgatac

SEQ ID NO: 26073 - DNA, 347 bp, Homo sapiens
  misc_feature 10, 41, 92, 99, 141, 302: n = A,T,C or G
aacattcagnaaggaaagaggggagtttggctgcgaatgcngggcaagggccaaagagatgtgacttattggaggggacttaatagtgtggncttcggnggaaaaataacctgttactcctgagaggatctgtctggagtnctctgtaaagacactttcattccttcaatcttttctcattgtttctagtggctgaactttcttaaaagtagtgtaggccaagacgggaggatcacctgaggttaggagtttgacaccagcctggccaacatatagtgaaaccttgtctctactaaaaaatncagaaatttagcctgggccttagggggggccccccctgtttaggc

SEQ ID NO: 26074 - DNA, 377 bp, Homo sapiens
attgagcaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatggcacttgcatttattgtattgtaataaatttcacttttaacttt

SEQ ID NO: 26075 - DNA, 444 bp, Homo sapiens
  misc_feature 2, 30, 235, 238: n = A,T,C or G
gntcttttcctccttggctgtctgaagatngatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggnggnggcaagacaactggctttggcatgatttatgattccctggattatgcaaagaaaaatgaacccaaacatagacttgcaagacatggcctgtatgagaagaaaaagacctcaagaaagcagcgaaaggaacgcaagaacagaatgaagaaagtcagggggactgcaaaggccaatgttggtgctggcaaaaagtgagctggagattg

SEQ ID NO: 26076 - DNA, 488 bp, Homo sapiens
gattgaatacagctgtgagaggtaacaccagtataatttttgaagccattcgaggagtatcaataagaagtgatattgccattgatgatgttaaatttcaggcaggaccctgtggagaaatggaagatacaactcaacaatcatcaggatattctgaggacttaaatgaaattgagtattaagaaatgatctgcattggatttactagacgaaaaccatacctctcttcaatcaaaatgaaaacaaagcaaatgaatactggacagtcttaacaattttataagttataaaatgactttagagcaccctccttcattacttttgcaaaaacatactgactcagggctctttttttctttttgcatatgacaactgttactagaaatacaggctactggttttgcatagatcattcatcttaattttggtaccagttaaaaatacaaatgtactatattgtagtcattttaaagtacacaaagggcaca

SEQ ID NO: 26077 - DNA, 240 bp, Homo sapiens
ggagccagcgtcaactacgatgactactaacctgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagc

SEQ ID NO: 26078 - DNA, 467 bp, Homo sapiens
ggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgcttttta

SEQ ID NO: 26079 - DNA, 407 bp, Homo sapiens
gatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactct

SEQ ID NO: 26080 - DNA, 451 bp, Homo sapiens
atatttattggtatgaaaagatctttgtgatatatatacacagtaaaatatatacatatatttagtaaaaatccaagttttaaaataagatgtatgctaagcctaatttaaaatatatatattcatgcctagattgatttagaagtaatattcgtgcagataacactgtgcatgggtgtatccctgcctgctcccctaaaataggtattgattcttttaaagtcttttgagggataataaaagagactatatttttcttttaattggttaataatctttgcttatttatgagttccaaagacacagatatttcatctattattgtatatttttatggaaagaagaaacatttaggacagaaactcgttatgatttcaaggtcaaacatgtatttcctaattgagatttggtttaaagttttaattcatagaataaaatgactgattattgg

SEQ ID NO: 26081 - DNA, 251 bp, Homo sapiens
  misc_feature 251: n = A,T,C or G
cagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccn

SEQ ID NO: 26082 - DNA, 486 bp, Homo sapiens
aacaggcaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgtttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatg

SEQ ID NO: 26083 - DNA, 469 bp, Homo sapiens
attgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactataggcattatgtttaaaataatctacaacaaaaatgtaccattttcaagcagtactacattaggagcccttttatagaaaataatttcttctttacccctgttccagtgtgaatctagtattctgttaacatttgtgtggcatttggagtttgtcatccccattgaagggagag

SEQ ID NO: 26084 - DNA, 482 bp, Homo sapiens
gcccttttggctctctgaccgcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaaga

SEQ ID NO: 26085 - DNA, 473 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaaatctctttttttctggaggctggcacctgattttgtatccccctgtagcagcattactgaaatacataggcttatat

SEQ ID NO: 26086 - DNA, 472 bp, Homo sapiens
  misc_feature 10: n = A,T,C or G
gacctaaagnacaactacataaagcagtacttatgaaataatgttgatagggttataacttataaaagatgcaatttgtatgatgataatagcacaaaggaggaggaagggaatagagctataccaaagtttttgagtattattgaaattaggttggcattaatctgagcctactttatgttaagatattaatcatagtccctagggcaacctctaggaaaaaaaactcaaaaaatacaataagaggaacaagaaggaaatcaaaatgatatactagaaaatacctatttaatacaaaaggcagtagtggagaaattaaatcaaaagacataagatgcataaaaggaaaagagcagatatcccacaagtgactcccaccttatcagtaattatattagaagaaaaccagttaaataattcagtcaaaagacagattacgggcgtgagcctctgagcctggcataacaattta

SEQ ID NO: 26087 - DNA, 320 bp, Homo sapiens
gacacgcttttcatctgtcccgctgcgtgttttcctcttgatcgggaactcctgcttctccttgcctcgaaatggaccccaactgctcctgctcgcctgttggctcctgtgcctgtgccggctcccgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttt

SEQ ID NO: 26088 - DNA, 401 bp, Homo sapiens
atctgctaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactc

SEQ ID NO: 26089 - DNA, 249 bp, Homo sapiens
ggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatga

SEQ ID NO: 26090 - DNA, 321 bp, Homo sapiens
ggaattagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtg

SEQ ID NO: 26091 - DNA, 427 bp, Homo sapiens
gacggttcgtttttcctttagtaggaaggacgttggtgttgaggttggcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactatgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacatttt

SEQ ID NO: 26092 - DNA, 500 bp, Homo sapiens
  misc_feature 8, 13: n = A,T,C or G
acggggtngtcgncctctatagccgggatgtccaacacattcaacactggtatacctcctaccagcaagcctttaaaatgcatttgtgtttgcttatttgttttgttcaagggttcagtaagacctacaatgttttgtatttcttgacttattttattagaaacattaaagatcacttggtagttagccacattgagaagtggttatcattgttaatgtggttaatgccaaaaagtggttaatattaataagactgtttccacaccataggcaataatttcttaatttaaaaaatctaagtatattcctattgtactaaatatttttcccaactggaaagcacttgattgtacccgtaagtgtttgagtgatgacatgtgatgattttcagaaagttgttgtttttgtttccatagcctgtttaagtaggttgtaagtttgaatagttagacatggaaattattttataagcacacacctaaagatatctttttagatga

SEQ ID NO: 26093 - DNA, 268 bp, Homo sapiens
  misc_feature 26, 70: n = A,T,C or G
atcataagggagtgtcaacttttgtnaaacttttcttctgcatctatttctttctttttgtgctttgctnctatttaaatgttagatttgtgaaatcacaataaatcctacatagacaggaaaaatcctcagagactactatgaacatctctatgcctgcaaactagaaaattaggagaaaatagataaaatcctggatacacaaacttccaagattgagccaggaagaaacagaagccttgaacaaagcaaaaatatataaaatagg

SEQ ID NO: 26094 - DNA, 209 bp, Homo sapiens
  misc_feature 25, 208, 209: n = A,T,C or G
gcatcctccagcatctcaactccgnctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtnn

SEQ ID NO: 26095 - DNA, 160 bp, Homo sapiens
  misc_feature 156: n = A,T,C or G
catgctaatcattcagtgtgatgcatcatatccacagaatgaaggacaaaaaccatatgatcatttcaactgatgctgaaaaagcattacaggccaacatcccttcatgataaaaactctcaaaaaactgggtatagaaggactatacctcaatanataa

SEQ ID NO: 26096 - DNA, 470 bp, Homo sapiens
gtttcctagttcggctggttcttctgtcgccggcttcagcagcccgcgcccgggcaggggcctggagcagtatctagcacaaagtagacactcagtaaatatttggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtt

SEQ ID NO: 26097 - DNA, 500 bp, Homo sapiens
  misc_feature 9, 15, 169, 171: n = A,T,C or G
ccagggtanttcggncttatggccggatagtgacacaattataattctacaacatttcggatgctgtgaatattgctgtaccacttttttttttaattattgttacaggtcatgtcaaaaccaaaaaatattagactctgaacgttgcagtcttatagtacaatggagngnggattctttcattgtcaaattagatgaaaaaaagtttgttttttaagcaatgacacgatagctcagctaaaagaataaaatattgccattaccagactaagcacgcatcacatccctaactcatagataaacagcaatctgaaaaaaatagaaaattgtaaatggaatatcttatcatgacagaatttcttcaaaaaatgaaatacaaaaatgaggctgcaacttaaatttctcagcagctcacttatcagccaagcaaggaaatccttttgctgatgttgtagtataaaatcatgagtgattgcagcaactaaagtgctggcattaca

SEQ ID NO: 26098 - DNA, 490 bp, Homo sapiens
  misc_feature 7, 470: n = A,T,C or G
agtgtanaaaaggggtctcaaatgatctagctgaaatctttcatttggctgctgaaggaaacatctataggaagattgtgatatacccattgttacagtgttagctcctctagattctcaggaatatgctctttccatcatactgaaggtgttggaagtttaattacagtttaatagtataatcacaatttaatagtttaatcatactatttgagcaaagtttttgggacactgttacgactatttccctcaaaatatcaacatttagattaaatggttttccagaaatttccaatagttacaaaaataatttgaagttgtcataaatattaatttatgttggtatatatgacataatatacaattaactttaaaactttcaaatgtaaaatgtattaagaacaaattgagaaacagtattgtggctgggtgtggcagctcacacctgtaatcccagcactttaggaggntgaggcctgtaatcccagcg

SEQ ID NO: 26099 - DNA, 419 bp, Homo sapiens
agctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttg

SEQ ID NO: 26100 - DNA, 146 bp, Homo sapiens
ggaccctgggagagaaggactgattggaattggctgtgggaaaggtcctttggaccccatatttgttgctctttgactctgcaaagatgaaaatacttgggaaggtaaaagtgactgatggtccaaatttgggttataaacagacc

SEQ ID NO: 26101 - DNA, 438 bp, Homo sapiens
  misc_feature 12: n = A,T,C or G
gaattaaaattnagttaagcaattctggtgtccctaaggtactctgatatttttgtgtgtagctaattcgtcaaaaaataatgaaaacaataacttaaatatgtgtagcaatttatggtttcaagtaccatcatatttagttggtttgatcctcacaccgtcaatattacagaagttcatgcaaggtgagtaattggccttaggcaaaaacaactaattaatattaaagacagaattgaaagataccttgttatttctctctcagttaagtcttttaaccatcaagtaaggagagaagaggaaaatcaaaactaaaatgatagagtatctaaaagttaatggaagggaaaacttcttattaaaactgtgctcctcaatgatttttagtatttaataaaaaaacaaaaattgaaaataaatgagccatgtatgcatcat

SEQ ID NO: 26102 - DNA, 489 bp, Homo sapiens
gaaactattttaaactgtttaattttcagtaaaaaaataatatagtttttattaaataaaaagttgatacctatgctttcagagtctgtgaattagagacaccatcttgacaccaattacttctcatattaatttggttttgttctagaggcttcagcttacaagtttcagaggaggtccttctctaaaggtgttttttgtttccttcattgtttaatatgggcaggtttccgtaatctcgatacaaaaccttgataaggccaggagcggtgattcaagcctgtaatcctagtgctctgggaagttgaggcaggaggattgcttgatgccaggagttcgggaccagcctgggaaacatagtcacatcttatctgtacaaaaaaattagaaaaattagctgggcatgatggtgcacctttaatcccagctacgcaggaggctgaggcaggagaatttcttgggatctcgagttctaggctgcggtgaact

SEQ ID NO: 26103 - DNA, 499 bp, Homo sapiens
  misc_feature 9: n = A,T,C or G
gagggtatnaggcggagaagatcctgagaggagaaaggcaagatggggactcttagaaagtattcttaaaatgggcaggaaatgtgaaaagggactttaaaaagaggattgtgggatgagcaatgaataagtaaaagggtgcttaacctcatcactcatcagggtagtgcaaattaaaaccacaatgagataaaaatactaccagaataactaaacaaaaaatgatggatcaaaccaagtgttggccaggatatgcaggaattgaactgtatgacagtgccggtgtgagtgtaattagtgcaacccctgtggtaaactatttattgctattgttagaattgaacatatgcatatcctacatcatggcaatgctatttctaggtgtatacccaggcacaatgagaacatatgaccactgagcatcatgtacataaatgtttatagcagctttattcacaatagccatatttgaaaataataaaaatgtccaccaacagta

SEQ ID NO: 26104 - DNA, 273 bp, Homo sapiens
  misc_feature 22: n = A,T,C or G
aaatagcaagccggcgtaaagnagtgttttagatcaccccctccccaataaagctaaaactcacctgagttgtaaaaaactccagttgacacaaaataaactacgaaagtggctttaacacatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccc

SEQ ID NO: 26105 - DNA, 374 bp, Homo sapiens
  misc_feature 8, 30, 43: n = A,T,C or G
tatggaanaggtgttgtctttttaatagtnattccaaatatgngatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtcttcctgggagtgggtggaggcagccagggcttacctgtacactgacttgagaccagttgaataaaagtgcacaccgt

SEQ ID NO: 26106 - DNA, 372 bp, Homo sapiens
  misc_feature 349: n = A,T,C or G
tatagccggggggactccgaatgcaatggaacggaatggaatggaatggaatggagtggactggaatggaatagaatggaatggaatggaatggataggactggaatgaaatggaatggaatggactcaaatggaatggaatggaatggactggactcaaatggaatggactcaagtggaatggaatggaatggacacgaattgaatggaatggaatggactgtaatggaaaggaatggaatggaacggaatggactcgaatggaatggaaaggactcgagtggaatggaatggaatggaatggactcgaatggaatggagtggaatgtatgcgaatggaatggaatgnaatggaatggatccgagtcaaac

SEQ ID NO: 26107 - DNA, 431 bp, Homo sapiens
  misc_feature 7, 32: n = A,T,C or G
atacacnaatagacatcaaactcaatgctttntttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcat

SEQ ID NO: 26108 - DNA, 467 bp, Homo sapiens
ggctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagctttccgtgcccagaggaatctctacattgctggcttttccttgctgctgtccttcctgcttagacgcctggtgactctc

SEQ ID NO: 26109 - DNA, 103 bp, Homo sapiens
  misc_feature 17, 33: n = A,T,C or G
ggggttccgattccggngagggagcctgagtanacggctaccacatccaaggaaggcagcaggcgcgcaaattacccactcccgacccggggaggtagtgacg

SEQ ID NO: 26110 - DNA, 171 bp, Homo sapiens
  misc_feature 27: n = A,T,C or G
gaaaactggcaagcacagaagtacggnaaggcgaagaaaagaatagagaagatagggaaattagaagataaaaacatacttttagaagaaaaaagataaatttaaacctgaaaactggaagacagaagtacgggaaggcgaagaaaagaatagagaagatagggaaattgg

SEQ ID NO: 26111 - DNA, 500 bp, Homo sapiens
  misc_feature 3, 7, 44, 95, 152, 177, 213, 278, 281, 287, 325, 395, 429,486, 496: n = A,T,C or G
tcnatancactagaaggccttgaggcagccagcgcaggggcttntgctgagggggcaggcggagcttgaggaaaccgcagataagtttttttctntttgaaagatagagattaatacaactacttaaaaaatatagtcaataggttactaanatattgcttagcgttaagtttttancgtaattttaatagcttaagattttaagagaaaatntgaagccttagaagagtaccatgaggaaggaaaagataaaaggtttctaaaacatgacggaggtnganatgaancttcttcatggagtaaaaaatgtatttaaaagaaaatngagagaaaggactacagagccccgaattaataccaatagaagggcaatgcttttagattaaaatgaaggngactttaaacagcttaaagtttagtttaaaagtngtaggggattaaaataattttgaaggcgatcttttaaaaagagattaaaccgagggngattaaaaanacct

SEQ ID NO: 26112 - DNA, 422 bp, Homo sapiens
  misc_feature 8, 32: n = A,T,C or G
gaaggggnggggaacgacatgcatgtgagggntggcacactgatgtgtttatgcacctgtacacaggagcgcatggccatggctttggaaaggagaatggaaaaatagaagaaggtcggccgggcttggtggcttatgcctgtaaccccagcactttgggaggccgaggtgggccggatcacctgaggtcaggagttcgggaccagcctggcaaacaccccatctctactaagcgaaaacccatctctactaaaattacaaaaattagctgggcatgattgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaag

SEQ ID NO: 26113 - DNA, 376 bp, Homo sapiens
  misc_feature 1, 2, 25: n = A,T,C or G
nntcaaatgcccagtagaacgtgantttaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactgg

SEQ ID NO: 26114 - DNA, 368 bp, Homo sapiens
  misc_feature 241, 271, 297, 305, 312, 344: n = A,T,C or G
ggagataatggagaagcagcacgtctatctatacacattaatatttataaaatgctacatgtgaataatcagtacggtgatcagcaaggataaaggagagagctggcaagattaacatgctactgtttatgaagctctctaactttgatactcataacaactctgaaaggcacctagagtgtccttggagtttaattacctttttccataggagctgtttcaaggagaaaaaaaaaaaganggttaataatatgactcttaggcccagagngatggctcacacctgtaatcccagcntttcaggnggctganacaggaggatcacttgagtccaggagtttganaccagcctaggcaacatagtaagg

SEQ ID NO: 26115 - DNA, 314 bp, Homo sapiens
ataggtttggtcccagcctttctattagctcctagtaagattacacatgcaagcatccccattccagtgagttcaccctctaaatcaccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctc

SEQ ID NO: 26116 - DNA, 484 bp, Homo sapiens
  misc_feature 3, 14, 36: n = A,T,C or G
atngaccgggaagnataagggaatttcttcaaaagnatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacagctgtattcaggtaactgaagattttgtgtctccagaacatcttgtagagtcatttcatttaacacaggaactgagacttttgaaggaagaaatcaattatgatgataaactacaggttaaaaatattttgtatcatgcagtcaaagaaatggtgagagccttgaagatacacgaggatgaagtagaggatatggaagaaaattaagtgtgatccagtttgatatttttaggttgttgaactgggattacttaac

SEQ ID NO: 26117 - DNA, 472 bp, Homo sapiens
  misc_feature 17, 40: n = A,T,C or G
tatagccggggagtccnagtggagagagcgagctgagtgnttgtgtggtcgcgtctcggaaaccggtagcgcttgctgcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcaggggaagcagatat

SEQ ID NO: 26118 - DNA, 211 bp, Homo sapiens
  misc_feature 1, 7, 151: n = A,T,C or G
nctttangaaaatttatgatagtagtcctaagtggattgggaaatcagtgagcctcatcatctactggtaggattgcctgtcagttgccctgtgccagaagtaattctgttaatctgtgtgcagctccaaaagctgttgagcgtggactangaacatttcagctgctggttaaatctttctggcatatgtataaacttaaataattgcggg

SEQ ID NO: 26119 - DNA, 482 bp, Homo sapiens
  misc_feature 23: n = A,T,C or G
ggtttcggaaacattataaaagnattattaaatgttttcgtgctaaattttaacaatttctaactataagactaaatacatacattattactcatgttccatatgacctttctgttctgagacatttattcttaatgagaaaatgatttttttcttaacagttgttaaccctatatactaacttaatatgaatattaccaaataatattttaaaattaaaaacttaaaggtagacttgcaagagttcaactaaagaatagctggataacccagacagtaaagactaattaacatgtcacactccagaatcagtcatttctagttgtgaattccatctctgtcccttagttcctgtgtgagtttattaactgtggtgggacaactaagcctgtctcagctgcaaaatgtaaatgttagtacctacctaagagaggtttaatgaaggttaaatgagataagtatgccaagtccttaagtgtagt

SEQ ID NO: 26120 - DNA, 500 bp, Homo sapiens
  misc_feature 4, 5: n = A,T,C or G
cctnnatagccgggcaagggcaaaattaactccttacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgttctgagaagcacagctacctgccttcactgaaat

SEQ ID NO: 26121 - DNA, 468 bp, Homo sapiens
  misc_feature 437: n = A,T,C or G
ggaaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattngaaggcgatcttttaaaaagagattaaaccg

SEQ ID NO: 26122 - DNA, 490 bp, Homo sapiens
  misc_feature 32, 442: n = A,T,C or G
ctcattctttttcctcaaattttacctactgnggctcaagccttcacagtgagctgatggtctctacaggggaggggagtctagggaatttatttggtatttgtaaggcaagcggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagnaaaacaacataactcagatttctacaggagacagtggttttatttgga

SEQ ID NO: 26123 - DNA, 469 bp, Homo sapiens
gcttccttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggc

SEQ ID NO: 26124 - DNA, 471 bp, Homo sapiens
gggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaaactcctaaaacaccaaaaggacctagt

SEQ ID NO: 26125 - DNA, 497 bp, Homo sapiens
  misc_feature 12, 36, 61: n = A,T,C or G
aacacggggtanctcggctttatagccgggggaggnttctcggagttctcggcttcaagtnacaatacaacaagcaaaaaggcacctaagccctttttctcccctcagtttatgtttggctttaaagggataccccttagcagtgctttgtgggtttgtgctagtaggagggtaggaaggtagggtggggtgctggtttatttcccacaaatggaatctgtgcagtaccagtgccagtgcttaactgtgaccacatgggggcatggctggaacctgtcagggcccagtccagtggttctgacatttgcatatgaggtgccagtgtttatgatagccagttccattgtgctgtccttgagcctaagtgtaactcttaaggccggaaaagtctgtgtaaagctcatagaagagaagaaattgagcagagttgtcttagagcattagaatgtttccaactttcctctacaggaactgtggctgattagtatgtgtttgag

SEQ ID NO: 26126 - DNA, 472 bp, Homo sapiens
  misc_feature 12, 29, 44, 66, 294, 464: n = A,T,C or G
caatagcccggngatacgttcctgggctncatactggcaacatntttatccgcagtgggtatgggngacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagngggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccanaaagaaga

SEQ ID NO: 26127 - DNA, 256 bp, Homo sapiens
  misc_feature 9, 15, 26, 252: n = A,T,C or G
aggttcagnagcagnattagaacagnaaatcaggtagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtnccac

SEQ ID NO: 26128 - DNA, 499 bp, Homo sapiens
  misc_feature 18, 40, 68: n = A,T,C or G
atagaccggggagtgccnaaatcttcgagaagaatttctntttagttctttgcaagaaggtagagatnaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaatt

SEQ ID NO: 26129 - DNA, 494 bp, Homo sapiens
  misc_feature 6, 8, 30: n = A,T,C or G
gataantnatgaagtgtccctgtgaaattnaagtgaaactatctctgtaggacttaagagaatagctaaaaggtgtgacttgccttattgaaatgatactggcatatctgactgtaagcagtaggttgaagatatcattttatgaatgtggagaattctacattgaaacagaaaatacctgggaatgaagattaaaaatgtagctgctgttatttgcttggtgattcccctcttgctcttctttagtttgaaaaaacaaaaacgtggccttggaattttcattttgatgcagaaattttgaaattgaaaatgtgcatgttttggtgcacaaaatccttctgtgggcaaaactttgtttttgttttgcacagtaagaaacaataggcaagcgttatgtttttggtaagttaactatgaaagctttcttatttttattattaaaaatgtaacaatttaacccacaggaaaaaaaattactttgtatgctttgtttg

SEQ ID NO: 26130 - DNA, 473 bp, Homo sapiens
aattccgcgttagtatgaggacatttgtttgaattatagaaatttgccctgagccgaactgggttgtgttaacacattggtagagctatgattccttcccagttctaagagatacgatctgtaagtccctatgtcaccacattgcttgagatgatcattcagttacttgtcaggatttctcctcttcagagagatttttttttatagcacagattcctttgccccttttatctccttatctggatatgataagtggttatgagggtctcactaactattttgtgtttaccttttatatgtgtaaaactttgcagtagcatttaaagtgtaatttatttttctatcaagtgcactattcatttagtgtgttccagttttatatgacttgtattagaaacactgcactgagttgtttgtacactgaaatgagaactctagatgtaactctattcaaataaaccttcgtgagacat

SEQ ID NO: 26131 - DNA, 355 bp, Homo sapiens
  misc_feature 31: n = A,T,C or G
gtgaggaagtctggctagaatcgggcttctnaaaggcggtagtatccgtccctgatagaaatctgggtataggctgggtgcagtggctcacgcctataatcctagcactttgggaggccaaggcaggtggatcacctgaggtcagaagttcgagaccagcctggccaacatggtgataccccatctctactaaaaatacaataattagctgggcgtggtcgcaggcgcctgtaattccagctgcttgggaggctgaggcatgagaatggcatgaacctgggaggtagaggttgcactgagctgaaatcatgccactgcattccagcctgggtgacaagagtgaaactcagtccct

SEQ ID NO: 26132 - DNA, 443 bp, Homo sapiens
  misc_feature 246, 284, 324, 412: n = A,T,C or G
gaatctcgggttcttttttgactttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagngttaaatggagaagatacttgtttttattaaacatttngagatttagataaactacattttaactgaatgtctaaagngattatcttttttccccccaagttagtcttaaatcttttgggtttgaatgaaggttttacataagaaattattaaaaacaaggggggngggtaataaatgtatataacattaaataatg

SEQ ID NO: 26133 - DNA, 499 bp, Homo sapiens
  misc_feature 9, 487: n = A,T,C or G
gcttatcanaaaaatatactcacctctcctgcgataaagtcttctgccagccatggcagagatgcattgagggcacctgtgtttgtaaactaccgtatcagtgcccaaagaatggtactgcagtgtgtgcaacctaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccggaggattaaagaccagttttggntgaatgtacttt

SEQ ID NO: 26134 - DNA, 480 bp, Homo sapiens
  misc_feature 26, 182: n = A,T,C or G
gattctggaggcgaaaaacgcaaagntgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggnggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaaccggag

SEQ ID NO: 26135 - DNA, 467 bp, Homo sapiens
  misc_feature 185: n = A,T,C or G
gttgaaaattggttataattcctacctcacatgctatttcagatagtgactaataaacacattacatcactgtaatgtctttcccatgtagtcctgactgttcttgatagaacagattcaccatccagatcttatctatgcattgatccctcaataaaggaataacccaagatgaagttggcagngggtatacacacagctatgtcacaccaaacttgaaatactttttagaagttttaaatgctgataaacaaactcttaggacaaatcactaatgagcatggaattcccatcttcttcagatttattcatcataaatggttttcacagattttatcataaaaacataatcttctctttcattcatagtttataattcacatgatttattcacattaaccagctgtgattggagaatcagggaggagctttgagtcccatattttataaatgcttctgagaaggac

SEQ ID NO: 26136 - DNA, 470 bp, Homo sapiens
  misc_feature 56: n = A,T,C or G
ggggaagatgaatttgttccttcgatgggttagataaagatgaatatacattttcnccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatcttggctctgaaaatgaaggcgattataaccctggcag

SEQ ID NO: 26137 - DNA, 495 bp, Homo sapiens
  misc_feature 6, 34, 38, 75, 77: n = A,T,C or G
gagccngggtaatccggcttttatggcggggggnaccnggatcctgctcctctgggttgaaacccgggcgccgcnangaatgccggcttaccactcttctctcatggatcctgataccaaactcatcggaaacatggcactgttgcctatcagaagtcaattcaaaggacctgcccccagagagacaaaagatacagatattgtggatgaagccatctattacttcaaggccaatgtcttcttcaaaaactatgaaattaagaatgaagctgataggaccttgatatatataactctctacattctgaatgtctgaagaaactgcaaaagtgcaattccaaaagccaaggtgagaaagaaatgtatacgctgggaatcactaattttcccattcctggagagcctggttttccactttaacgcaatttatgccaaacctgcaaacaaacaggaagatgaagtgatgagagcctatttacaacagctaaggcaaga

SEQ ID NO: 26138 - DNA, 120 bp, Homo sapiens
  misc_feature 3, 31, 104, 108: n = A,T,C or G
agncctaaaaaattagacagacagcaacacnttaatagtgagggattttaatactccactgacagcactggacaggtcttcaagacagaaagtcaacaaagaancagnggatttaaacta

SEQ ID NO: 26139 - DNA, 470 bp, Homo sapiens
  misc_feature 15, 17, 22, 23, 428, 439, 465: n = A,T,C or G
gttcagggaaacagnanaaagnnttatttttaaaatatcttacaagatcttcattcccaaggcaagtcaggggaaaactggtggatgtttcagagtgtttgttttcaactaactacatgtgggagatccagaaaggatgtgatcacttaggacagccaattattgaatgtgcacacctgaatttctcagctgaattttttttttaatttaatggaccaagtcatttaaggcctcatgcattatgtagctcagtgacattttggctgtcagagcaagactcttttgatttggtagaatatctggctgtgtcttcctttatttcaaagaactatgattttaatctctttttattaaaatctaaaagaaatgatcttacaccacatttttcaagaagttatttttttttttgttttagaggaatctcaacngccaaatcagnaggctaatattaaaatattttaaatngggcg

SEQ ID NO: 26140 - DNA, 125 bp, Homo sapiens
  misc_feature 45: n = A,T,C or G
atagtcatgggtgtctgtaactccagctactcaggaggccaaggnaggagaattgcttgaacctgggaggtggaggttgagtgagctgagaccacaccactgcactccagcctgggcgatggagc

SEQ ID NO: 26141 - DNA, 472 bp, Homo sapiens
  misc_feature 315, 348, 451: n = A,T,C or G
ccgaagcaaacagtgtggctcatacaaggtgaatttctttcagctgactgctttgtaatgatttatatttaaattgttgcttgttgctcttgtagaagaagggagagcgcctgccctatctgtagccaccttactcaccacactgactgggcctggacagctttgctcagcagagctgggaaataggctgaacttgccttcaattgttttcatcagagtccttatttagttggtttgtattggggcaaaaatgtcatgtaggactggaagaattaaatgagatgaaaaatgaagtctgtagttgctaagaatggngcagggcctccatatgccagtacagcacagcanggctgggggactatgagcaaactaccagcatcaccatcggggtccacaggaaaatcttgggtgaagtgcagcatcttcctcacacacagggaggctaggaaanggcatacagacagccttcact

SEQ ID NO: 26142 - DNA, 112 bp, Homo sapiens
  misc_feature 21, 86: n = A,T,C or G
agcagaagggaaagccagagngtgagaaaaaagaggagtcagtcgctcctggggaagggagagagtgagactgggagaaagagaancacagaaagtgtgtgtaaaacggggt

SEQ ID NO: 26143 - DNA, 341 bp, Homo sapiens
  misc_feature 6, 15, 31, 37, 61: n = A,T,C or G
atggcnggagtgganagggggcatgtatagnagaagnaaaagttcacttttatggggaagnaagctgccttctcattttcatagactttctctgtccttctcgccttccttctttttctccctccctgccttccctgttcattaagggactaaactgaatgcctagctgaaagttgtatatactgtcctttagcaattcagaagagtgtttcatttcaactatcaataaatacttaatgagtccatactatgcaccaggcattttgctatgcccctagaggcacagtggccctcaggaaagcttacagcctagtaggggaaacagaaaaacaagtaaacga

SEQ ID NO: 26144 - DNA, 189 bp, Homo sapiens
  misc_feature 52, 65, 81, 85, 90, 96, 128, 132, 141: n = A,T,C or G
tataaatcaaaacatttatcctactaaaagtattggagaaagaaaattcgtncatctaggagctntagaactagtcccgcngggnaagangaaagnctaattaaaagggagaccaggcaaagattaancctngtccctttngcttaatgaactaactagaaaacttctaactaaaagaattacagctag

SEQ ID NO: 26145 - DNA, 500 bp, Homo sapiens
  misc_feature 3, 23, 39: n = A,T,C or G
cgncacagggtacctcgccctcnatagaccgggaacagnatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagt

SEQ ID NO: 26146 - DNA, 459 bp, Homo sapiens
  misc_feature 3: n = A,T,C or G
atncaaaggaagattgaaagtaattatcagtattctattgggcaagaagatggtggatttatagtagctcattgtgtcatctttgaaatatagacaaattaaaagaaagagggctaaggatgggccagtgataactgtggcattgctatgtatgaagaatgttgattgatccattgatccatgtgtgtcatactgagatgcgttataggaagagatctagtgtattatctctgtgggaaattagattatagacatgcacagtctagtatcatcagtgctagccactggagctactgtgcacttggaatgtgactagtctaatcgacatgtgatctacatggaaaaatacacaccgagtttagaagcctcaatatgaaaaaggtaaaatatttctagaattatttatatttattaaatgatagtattttagatattgggctaaataaaatacacaattac

SEQ ID NO: 26147 - DNA, 251 bp, Homo sapiens
  misc_feature 250: n = A,T,C or G
caccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacng

SEQ ID NO: 26148 - DNA, 488 bp, Homo sapiens
  misc_feature 144, 400: n = A,T,C or G
gggaagcggtggtttttagcggctctctgggtagcagggtggtgtgatagcggcagcgaggggctcggagaggtgctcggattctcgtagctgtgccggcccacaatgattctgagctaaaacacaaaataaaaaccagattcnttgccaccagcgctcacctcgcctgacttaaaaaaaaggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtntctagatgccatgatgaatgaggctccaggccccatcaattttcaccatgttccctcaccatgtttgggggagaagttaaatggcaca

SEQ ID NO: 26149 - DNA, 483 bp, Homo sapiens
tacaaaaagtagaggcaataacaccattacctcccaagaaagagaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaaaaactgaataacctcaccttcctctacttggaccataatgccctggaatccgtgcctcttaatttaccag

SEQ ID NO: 26150 - DNA, 472 bp, Homo sapiens
  misc_feature 24, 238, 342, 386, 395, 458, 470: n = A,T,C or G
taggattcatctttcttttaccgnagggggcctgactggcattgtattagcaaactcatcactagacatcgtactacacgacacgtactacggtgtagctcacctccactatgtcctatcaataggagctgtatttgccatcataggaggcttcatttcactgatttcccctattctcaggctacaccctagaccaaacctacgccaaaatccatttcactatcatattcatcggcgnaaatctaactttcttcccacaacactttctcggcctatccggaatgccccgacgttactcggactaccccgatgcatacaccacatgaaatatcctatcatcgnggaggctcattcatttctctaacagcagtaatattaataatttncatgattgngagaagccttcgcttcgaagcgaaaagtcctaatagtagaagaaccctccataaacctggagngactatatggangc

SEQ ID NO: 26151 - DNA, 480 bp, Homo sapiens
  misc_feature 7: n = A,T,C or G
caagcangccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgacactaccttcccacccatacacatccatgttcactgtaacaaactgaatattcacaataaagcttctgagtaacactttctgattactcatgataaactgacatggctaactgcaagaattaaatcttctatctgagagtataatttatgatgactcagtggtgccagagtaaagtttctaaaataacattcctctcacttgtaccccactaaaagtattagtctacacattacattgaagttaaacacaaaattatcagtgttttagaaacatgagtccggact

SEQ ID NO: 26152 - DNA, 415 bp, Homo sapiens
  misc_feature 31, 164, 233, 249, 265, 268, 296, 345, 401: n = A,T,C or G
gcttttcgatccgccatctgcggtggagccnccaccaaaatgcagattttcgtgaaaacccttacggggaagaccatcaccctcgaggttgaaccctcggatacgatagaaaatgtaaaggccaagatccaggataaggaaggaattcctcctgatcagcaganactgatctttgctggcaagcggcttggaagatggacgtactttgtctgactacaatattcaaaaggagnctactcttcatcttgngttgagacttcggggnggngctaagaaaaggaagaagaagtcttacnccactcccaagaagaataagcccaagagaaagaaggttaagctggctgncctgaaatattataagggggatgagaatggcaaaattagtcgccttcgtcgagagngccccttctgatga

SEQ ID NO: 26153 - DNA, 497 bp, Homo sapiens
  misc_feature 3, 84, 117, 128, 134: n = A,T,C or G
ggnccggggaactcggccttatggccggtagttcaaatttaaaaaattccattaaatattttattttatggagaatttaagcanatccttcagaagggccggatgaagatttaatgntgctaatagtntaattngctaataaataaaaattaaaatattttaaaattaaatatttaatatagaaggtttgacatcattcagaagtgtgagataaggatttaattaaatcattaatgcttgaattggatgatgtagacaatatgttattttgtagaaagggaagagccctgtaccactattgattaaggataatgtaatcaacaatataaaatagaatattctaagatacaatgttttgaataatgtttatttctcatattaaaatgtattatttattcaacattgattcataaaatgggatgtattagattattgatttttaacttaaaaaatgcatcatctttttctctatatcattcaaagcagaagtattttga

SEQ ID NO: 26154 - DNA, 206 bp, Homo sapiens
  misc_feature 7, 32, 66, 193: n = A,T,C or G
gtaccangtgaaatttagaagacgacgagagngtaaaactgattattatgctcggaaacgcttggngatacaagataaaaataaatacaacacacccaaatacaggatgatagttcgtgtgacaaacagagatatcatttgtcagattgcttatgcccgtatagagggggatatgatagtctgcgcagcgttngcccccgaacctg

SEQ ID NO: 26155 - DNA, 429 bp, Homo sapiens
  misc_feature 10, 11, 29, 51, 84, 115, 195, 218: n = A,T,C or G
agccggggtnntcggtcttatggccggcnttgaatacaaaacaaataagcntcacgcctgccttccttgatattgcacctttgnacatcgggggggctgaccaggaattctttgnggacattggcccagtctgtttcaaataaatgaactcaatctaaattaaaaaagaaagaaatttgaaaaaactttctcttngccatttcttcttcttctttttnaactgaaagctgaatccttccatttcttctgcacatctacttgcttaaattgtgggcaaaagagaaaaagaaggattgatcaggagcattgggcaatacagtttcattaactccttcccccgctcccccaaaaatttgaatttttttttcaacactcttacacctgttatggaaaatgtcaacctttgtaagaaaaccaaaataaaagttg

SEQ ID NO: 26156 - DNA, 226 bp, Homo sapiens
ggactttgagttaagattattttttaaatcctgaggactagcattaattgacagctgacccaggtgctacacagaaagtggattcagtgaatctaggaagacagcagcagacaggattccaggaaccagtgtttgatgaagctaggactgaggagcaagcgagcaagcagcagttcggtggtgaagataggaaaagagtccaggagccagtgcgatttggtgaagg

SEQ ID NO: 26157 - DNA, 324 bp, Homo sapiens
  misc_feature 17: n = A,T,C or G
atggcccgggaaatgcncattttccttgttacctcgatgcttaagaattcatttagtaggtacatctattgtagctgtgattattccagtttctgtgtgatgcaatcaaatgtcctattaattattatttcatgtcatttgtagctactgatacagcagaaatgaagggaaccgtaattacttgtatttttgtaagccatacgttaaatgtttgttacatcatctttctgcttctatttttatgccaatgaaggcatttgtcttgttactaattacatgatgtaactacttcttgatataaataaatttttattttaattacta

SEQ ID NO: 26158 - DNA, 361 bp, Homo sapiens
  misc_feature 7: n = A,T,C or G
gaaaatntcactatttattggaacatttaaaataaagataaggtaacaaaaccatgttgtggtaaggatgaacaaccaaacactcatatgtttttgatgagaatgtaaattactatagccactttggaaaacagattagcactttctgttataaattcatacatgcacttattgtatgactgagcaattccatttccaggtttttaccaaggaaaatgaaaatatgtctgcacagtatctgtacatgaatatttatagcaattttatatgggacaaccccaaactgaaaacaactatagtgtccattaattggtaaataaataaactcattggggcatatccatacaatgaaatgctactt

SEQ ID NO: 26159 - DNA, 388 bp, Homo sapiens
  misc_feature 12, 305: n = A,T,C or G
agccaaccaagnagcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggtgattattttttatactgtatgtgccaaagctttactactgtggaaagacaactgttttaataaaagatttacattccga

SEQ ID NO: 26160 - DNA, 405 bp, Homo sapiens
aacacggtttaagttttatcctgcaagatagtaaagctaaccaagggttagaaatggtcccttattcaatgtaaagatatccaacaggatagtttagggattcggattaattttaaagaaataactcagtgctagactgtaatcccagcactttgggaggccaaggtgggcagatcacttgaggtcaggagttcaagactagcctggccaatatggtgaaacccccctctctactaaaaatacaaaaataaaccgggcatggtggcacacgcctgtagccccagctactcaggaggctgaggcaggagaatcacttgaacccaggaggtggaggttgcagtgagccgagatcgcaccactgcactacagcctgggcgacagagtgagagtctgtctcaaaatact

SEQ ID NO: 26161 - DNA, 460 bp, Homo sapiens
  misc_feature 2, 13: n = A,T,C or G
gnccgggggaagnacccatctaagtatggcgactgtcgaactggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactac

SEQ ID NO: 26162 - DNA, 490 bp, Homo sapiens
gattcctgaagctgacagcattcgggccgagtatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacac

SEQ ID NO: 26163 - DNA, 470 bp, Homo sapiens
  misc_feature 458: n = A,T,C or G
attggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatattttgggntggtctcaatga

SEQ ID NO: 26164 - DNA, 260 bp, Homo sapiens
agagtacttcgagtctcccttcaccatttccgacggcatctacggctcaacattttttgtagccacaggcttacacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtcttaaagcaaaaaag

SEQ ID NO: 26165 - DNA, 232 bp, Homo sapiens
  misc_feature 190: n = A,T,C or G
attaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaatttaatatgaaaatcacctcggagctggnaaaaagaggcctaacccctgtctttagatttacaggccaatg

SEQ ID NO: 26166 - DNA, 285 bp, Homo sapiens
  misc_feature 2, 176: n = A,T,C or G
gnagcacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagnattcctctctctaaaataaagaccctttttcctctgattgaagccaagaaaaaggatcaagtgactgctcaggaaattttccaagacaaccatgaagatggacctacag

SEQ ID NO: 26167 - DNA, 169 bp, Homo sapiens
  misc_feature 4, 6, 32, 37, 149, 161: n = A,T,C or G
gaantncaaaactagccagaattgttcacatnttggnattttcaacgaggggaaaaaacttgagataccagctattacagctggtagaaaccatttggagtcatttcaaatcatctgattctaaataaaaataatgaggctttttttgnaatggccacccncaggagga

SEQ ID NO: 26168 - DNA, 464 bp, Homo sapiens
  misc_feature 30, 73, 198: n = A,T,C or G
aaagcctaatatagcaaggactaacccctntaccttctgcataatgaattaactagaaataactttgcaaggngagccaaagctaagacccccgaaaccagacgagctacctaagaacagctaaaagagcacacccgtctatgtagcaaaatagtgggaagatttataggtagaggcgacaaacctaccgagcctggngatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatc

SEQ ID NO: 26169 - DNA, 476 bp, Homo sapiens
  misc_feature 4, 5, 92, 93, 192, 362: n = A,T,C or G
gggnntgaatctatgacaggagcaatgctttttaatgaatttaaggcaaaaaaggtggagagggagatgtgtgagcatcctgcaaggtgaannaagactcaaaatgacagtttcagagagtcaatgtcattacataggaacacttcggacacaggaaaaataaacgtggattttaaaaaatcaatcaatggngcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgngttgaagaagggttatcctttcattaggcaaagtacaaaattgcctataatacttgcaactaaggacaaattagcatgcaagcttggtcaaactttttccagcaaaatggaagc

SEQ ID NO: 26170 - DNA, 467 bp, Homo sapiens
cttctttacagtacaattgttctgaaaatttgtaggggaattgactcagaatgtacatttattttcgtcatactatcagagatgtttaatttcctttgaatgattttattcttaactgtagcacttaacacttttttctgtcttctttcctctcaaaattaatgtctgtaaactaatgtttaagtggcctagagagtctcttaatgtaaaagcttgttgtaaagttggaaatcttttgtaatttgaataccccttgattgctgtccttcagtgcattggattgtcctagggtgttctaatagtatttctcaattagctgataaaagaattttagaggctgggtgccctggctcaatcctgtaatcccggcactttgggaggctgaggtgggaagattgcttgagctcaggagttgaagaccaacctagacaacatagtgagagcccaccgtctctgccaaaaaatgt

SEQ ID NO: 26171 - DNA, 399 bp, Homo sapiens
  misc_feature 375, 395: n = A,T,C or G
atattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttgccaaatttttctgaatgtgacctttttttgctgatttgctgggtttgggattaactagcattattttgccacctttatattgtatttataaaaaaaaaagtactatcaatcaatcatactactttggattgttgggctggggtaatgnggatttaacatcaataaatntttg

SEQ ID NO: 26172 - DNA, 468 bp, Homo sapiens
  misc_feature 7: n = A,T,C or G
gggttgnagagttgagtgtcctgagaagtcatgattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatata

SEQ ID NO: 26173 - DNA, 180 bp, Homo sapiens
  misc_feature 5, 25, 38, 78, 92, 133, 158: n = A,T,C or G
ggcancaaaacctaccgaacctggngattgttggttgnccaaggatagaatcttagttcaactttaaatttgcccacngtaaccctctaaanccccttgtaaatttaactgttagtccaaagaggaacagctntttggacactaggaaaaaaccttgnacgagagagtaaaaaatttaac

SEQ ID NO: 26174 - DNA, 172 bp, Homo sapiens
  misc_feature 11, 22, 30, 44: n = A,T,C or G
gcacggggtangcccggctttntatggtcncgggtatcaacagnttagcttttctctgccatctgagaagatgaactaacgaatggctaaagttagaagtttagaatggaaataaggtctgactcttgaaatccttccagcatctttttctttagcaactctgttccacagg

SEQ ID NO: 26175 - DNA, 471 bp, Homo sapiens
  misc_feature 7, 25, 33, 290: n = A,T,C or G
gatgaancaaccagtcgtaaagcanaacagaantcggagtgaaaagaaggcacggaaggctatgtccaaactgggtcttcggcaggttacaggagttactatgagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagtccaaggtgaagctgtctcaaacattcaaganaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgt

SEQ ID NO: 26176 - DNA, 266 bp, Homo sapiens
  misc_feature 191, 266: n = A,T,C or G
gattccaaattgtaaagaccatcgacactataaagaaactgcatcaactaacggtcagaataaccagctagcatcataatgacagggtcaaattcacacataataatatgaaccttaaatgtaaaagggctaaatgccccaattaaaaggcacagactggcaaattggataaagagtcaagacccattggngtgctgtattcagaagacccatctgatgtgcaaagacacacataggctcaaaataaagggttggaggaatattan

SEQ ID NO: 26177 - DNA, 152 bp, Homo sapiens
  misc_feature 3, 6, 25, 30: n = A,T,C or G
ggngtntgcctgtggtcccagtggnatgtncccatggtcccagctatttgggaggctgactcagagggatcacttgggcccgggaagtcgagatggcagtgagctgtgattgtgccacttggcagaactgggcaacagagcgagaccctgtc

SEQ ID NO: 26178 - DNA, 225 bp, Homo sapiens
gatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagtcggcgtaaagagtgttttagatcaccccctccc

SEQ ID NO: 26179 - DNA, 382 bp, Homo sapiens
acctgaaaatagaagattcatcaatataatattatagcaaagacagttaaaatgttataggctaatgtgagtttacagaaggctttttaaagacataagtgaggtgtttaatgaagggaatgccattcaggagatgggaccaatcactctatctggatcaccaccctcagaaaaaatttgccttttgctgttccctgattgcaatttataacagtaggtataaacaagacaatattgaaagtaaataggtgaatttaataaaattgatctcagaataaacataaaattaagaaataggatactctaatgtgattatctagattatctagttatctagagagattactagtcaaataagaatacatttgttaaaatgaccacc

SEQ ID NO: 26180 - DNA, 156 bp, Homo sapiens
  misc_feature 39, 64, 90, 96, 140: n = A,T,C or G
tatggacgggtatcgcttgaacctgggaggcagaggttnatgtgagccgagaattgcgccactncctccagtctggagacacagcaagantttgtntcaaaacacacacacacacacacacacacacacacacacaacanaacacaacacaacaac

SEQ ID NO: 26181 - DNA, 398 bp, Homo sapiens
  misc_feature 51, 77, 90, 282, 295, 386, 393: n = A,T,C or G
ggatcttcctgcgctgaaccgcccgctgacccgacattgccgcgtcttggngattcggcccgcgagctccgttttcnttacagcattggnggcctactggagacaggctggactcagctacatccgatactcccagatctgtgcaaaagcggtgagagatgccctgaagacagaattcaaagcaaatgctgagaagacttctggcagcaccgtaaaaattgggaaagtaaagaaggattaatctaccctgactaaagcttgaaatgctacattttccaaggngaagatgtgtggnccatgttatggcagatggaaaaggatctcattccatgggaaaaaaaaatcctgtcttgttcataaaatggacaatgtcaataaattgaaantttggtncactg

SEQ ID NO: 26182 - DNA, 462 bp, Homo sapiens
  misc_feature 96, 102, 127, 361: n = A,T,C or G
aactttaaggaaaaggaaaaccaccaaatgtatgttgaaaaaagttatttaccatgatattgaagcttatgttcctcccatgcaaataatcaatcntctggngaaagtatctcatttgacgtgaganccagagtagcttctgaacctaaattcagaagagcctgctggactgcaataaagcacattggacagatgggttccattcttgattcatttacaaatgctggttgatgaccgaggccaaggccctttccttccctgagcctgtttaaaaatggtgctagatcgaggtttgttaaattcttccacaaaaaaagagtggaggaatgtgttcaagtcctcaaagaatttgaccacaggnggaaggagcctatgactagataaaatttctttgaagtatcatgttttacttttgaaaattaggggttttttttttgccttctactccatcatatatacatg

SEQ ID NO: 26183 - DNA, 129 bp, Homo sapiens
  misc_feature 49, 62, 82, 94, 96, 100, 111: n = A,T,C or G
ttttagaagttgtgagaatctattagaaaaatgcccagcttgcccggangcactggcttatnccttgtaatcccagcatttngggaggccgagnangacnaatcacaaggncaagaagttcgagaccag

SEQ ID NO: 26184 - DNA, 390 bp, Homo sapiens
  misc_feature 40: n = A,T,C or G
gttttgctaacaggatgatatgtttaaaaccaaatatatnaataattacattaaatataagtagactactcgaaacaaagatgtcactttggattaagaaaaatcattgtgtactgattataagagatgcatgggaaagagtgaaggaacagaaaatattaataatgtatacattaatgtagcttggtataattatagtaagatgaaacaaagcagactttcaggaagaaaagtattacttcctccagaagacaaaacaattctggccgggcgcggtggctcacgcctgtaattccagcactttgggaggcaaaggcaggtggatcacgagatcagaagatcgagaccatcctggctaactcggtgaaaccccgtctctactaaaaatac

SEQ ID NO: 26185 - DNA, 438 bp, Homo sapiens
  misc_feature 3, 6, 33, 35, 50, 59, 117: n = A,T,C or G
atnctnccggaagtacccgcaaaactctagtantnggagttgagcaggcncagggctgncatcaacatggatatgacatttcacaacagtgactagttgaatcccttgtaacgtagnagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctaatttctacattctgtcattagctattatcatctaacgtttcagtgtatccttacagaaataaagcagcatatgaat

SEQ ID NO: 26186 - DNA, 427 bp, Homo sapiens
  misc_feature 72: n = A,T,C or G
gaattcagaaagcagcacaattgagcaaagtcacagaaataaacctctgatatgaaatctctccttattggngtgaaagcaaattgtgaagcaaagagttggactaaaaagaggaaatgtaaatctatacttgaaaagaacaatttaataaattaattttatactggttcaactatattatttaatattaagatccagtaagttcaggttttcaaatttttggcaaattaaggcatccaaacttgttgagcttctgtagtcacatgccgtacacattcatgctacatcatagagactattgtgtgtgaatagttacaggtgacccatactaattaaaaagataaaatatatttatgataagtgaataatgtctttgtcatttcaaactaaaatggaatgatcaagtgggacagtttacacaaaaagc

SEQ ID NO: 26187 - DNA, 117 bp, Homo sapiens
  misc_feature 34, 58, 100: n = A,T,C or G
aggaaacacaaatgggtattcttttctacaaccnttttcaaatgaaccttagaaaagncttaacatttaaggtattttatgcacagaatacacttagatngataggaaagaactcgt

SEQ ID NO: 26188 - DNA, 295 bp, Homo sapiens
  misc_feature 6, 12, 65, 77, 95, 155, 160, 169, 204, 212, 236, 275: n = A,T,C or G
cgttcntctccnaaaggaaaatggatggatgcctgacaaccctccaaaagaaaaaagggtaaganagccattaagangatgacaattttggaaangaacattatgatatttatgaacaataaacaaatttccgtatggattgaattatccaaaangagtntaacaaaangaaatccttaaaaatccagagtttatatttttttnataccctnacttgtttgcactaactttatagnggaccaaggctgttaccataggaagggacaaacttcctngtaggcaactcagggttaga

SEQ ID NO: 26189 - DNA, 129 bp, Homo sapiens
  misc_feature 3, 4, 84, 108, 115: n = A,T,C or G
gtnntcggcctttatggcggggtaagcaagtttttttttagtgtaggagaaatacttttccattgtttaactgcaaaacaagangttaaggtatgcttcaaaaatttngtaaatngtttattttaaact

SEQ ID NO: 26190 - DNA, 500 bp, Homo sapiens
  misc_feature 10, 15, 27, 29, 136, 156, 252: n = A,T,C or G
accgggtatncggcnttatggcggggncnaaaaggcttcttattcgggtgtgagtcttttcagcaacccggtccagtactgggagatacagccatccaccttcagatgtgtctacgtgcgctctgcatttcaactnggaaactataagtaattctnaagaaagccctcatttttataaccctggcaaaatcttgttaatgtcattgctaaaaaataaataaaagctagatactggaaacctaactgcaatgnggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtct

SEQ ID NO: 26191 - DNA, 465 bp, Homo sapiens
  misc_feature 2, 25, 30, 307, 410: n = A,T,C or G
gnagtctgtcgatcccaggccaganaaagntagacaaaggttcatttgtaaggaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaacctttgctgctaggagttcaagccatgcctgcaaatcgcctctcttgctacagaaagatactaaaagatcacaactgtcacaaccttccggaaggngtagcttgacctgacacagattgatgtcaatgtccaggatcatttctgggatgggaagggatgtgagatgatctgttactgcaactttcagcgaattgctctnctgcccaaaagacgttttctttggaccaaagatctctttcgtgattccttgcaac

SEQ ID NO: 26192 - DNA, 476 bp, Homo sapiens
  misc_feature 319, 378, 474: n = A,T,C or G
gtcaggcattagaaaacaaaagtgtttcttcatatctaggagatttggaaattctgaactaaggtcttataagaacaagaaatgagcaaagtgttcattatagatactagggaaaagctttgttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagngtagcactttttagagccaaaaaacctcaggcacaaagaagttaaataacttgccgggngcgggtggctcacccctgtaatcccagcactttgggaggccaaagcaggcggatcacctgaggtcaggagtttgagaccagccgggccaacatggngc

SEQ ID NO: 26193 - DNA, 345 bp, Homo sapiens
  misc_feature 12, 27, 28, 114: n = A,T,C or G
cctttccggcgnggacgacctacgccnngagaacatgcctctcgaaaaggatctccttcatccctctccagaagaggagaagaggaaacacaagaggaaacgcctggggaggancccaattcctacttcatggatgtgaaatgcccaggatgctataaaatcaccacggtcttttagccatgcacaaacggtagtttttgtgtgttggctgctccactgtcctctgccagcctacaggaggaaaagcaaggcttacagaaggatgttcctttcaggaggaagcagcactaaaagcactctgagtcaagatgagtgggaaaccatctcaataaacacattttggtt

SEQ ID NO: 26194 - DNA, 392 bp, Homo sapiens
  misc_feature 10, 41, 179, 195: n = A,T,C or G
tatggcgggngatttccatttgtatttgtgttgatgatggnccacttgaccatcacatttcagtattcatagatgactgtcacattttaaaatgttcccacttgagcaggtacacaactggtcataattcctgtctgtgtaattcgatgtatatttttccaaacatgtagctattgttngctttgatttttgctngcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgatttca

SEQ ID NO: 26195 - DNA, 293 bp, Homo sapiens
  misc_feature 5, 25: n = A,T,C or G
cggcnttctatggcggggattcccncatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaag

SEQ ID NO: 26196 - DNA, 329 bp, Homo sapiens
  misc_feature 321, 323: n = A,T,C or G
ataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagngnggtaac

SEQ ID NO: 26197 - DNA, 481 bp, Homo sapiens
  misc_feature 31: n = A,T,C or G
atgtacctgtgatccagcaagtagggagttncagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagt

SEQ ID NO: 26198 - DNA, 399 bp, Homo sapiens
  misc_feature 345, 355, 380, 383: n = A,T,C or G
aagacagcaaccgtgcagatggtaaacagagcagtgtttggcagggttcaaagtacagtcgggttaacttggtgaagctaaggggattactttagagtgtgaaaattattctgtaggagcctgatgtggacacacggcatggtgaatttgtcaaaacacatagacctttacacacagagtgactaatgtaatccacaggctaaaaaagaaaattgcataagcatataatttgacattaaaatcatctgaaaaaattcaacgtccattcataataaaactcttggagtactaggaatagacagaagttctcgacttgatttttaaaatatataaaaatcttatagntaatatgatnctgaatagggagaaactctgggctntgntggactgggaacaaag

SEQ ID NO: 26199 - DNA, 373 bp, Homo sapiens
  misc_feature 300, 301, 309, 359, 373: n = A,T,C or G
gacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggnncaactgtncttagactgatgagcaaaggaggagtcaactaatgaagaaatgaataatnaattttgacactgn

SEQ ID NO: 26200 - DNA, 371 bp, Homo sapiens
aactagaaataactttgcaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacttacctaaaaaat

SEQ ID NO: 26201 - DNA, 470 bp, Homo sapiens
gaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtggttcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcag

SEQ ID NO: 26202 - DNA, 500 bp, Homo sapiens
  misc_feature 12, 13, 70, 473: n = A,T,C or G
tatagaccgggnnagaccgcaactggacgttgtgaacaggagttagctggtaaatgtcctcttaaaagcncccaaaaaatgagacttctagcaaagcattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatataataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacangatggatggaccaatgatattcctata

SEQ ID NO: 26203 - DNA, 498 bp, Homo sapiens
  misc_feature 3, 10, 453, 465: n = A,T,C or G
cgnccttatngaccggggcggtggctcacacttgtaatcccagcactttggaaggccgagacgggcagatcacctgaggtcaggagtttgagaccagcttgaccaacatggcgaaaccccgtccctactaaaagtacaaaagtggccgggcgtggtggcgcatgcctgtaattccagatactcgggaggctgaggcaggagaatcacttgtgcctgggaggtggggttgcggtgagccgaggttgcgccattgcaccccagactgggcaacaagggcgaaactccgtctcaaaaactaactaaataaataggaaaaaattcttccagcctaggtaacatagtgggacccagtctctacaaaaaattttaaaaattagccagaagtggtgcatgccttgtagtcccagctactcaggaggccgaggtgggaggatcactttgagcccaggaggncaaagctgcagngagccatgattgtgccacttgcccttccagcat

SEQ ID NO: 26204 - DNA, 487 bp, Homo sapiens
  misc_feature 6, 30, 138: n = A,T,C or G
gttggntcaagtgacttctgcccacctggncacaacaccaaaaaggcttcttattcgggtgtgagtcttttcagcaacccggtccagtactgggagatacagccatccaccttcagatgtgtctacgtgcgctctgcnattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccagga

SEQ ID NO: 26205 - DNA, 479 bp, Homo sapiens
  misc_feature 30, 32, 251, 453, 475: n = A,T,C or G
ggcctctgcgcgcgggaaagatggcggaantngctaccaagtccgtgctgtttgtgtgtctgggtaacatttgtcgatcacccattgcagaagcagttttcaggaaacttgtaaccgatcaaaacatctcagagaattggagggtagacagcgcggcaaccttccgggtatgagatagggaacccccctgactaccgagggcagagctgcatgaagaggcacggatttcccatgagccacgttgcccggcngattaccaaagaagattttgccacatttgattatatactatgtatggatgaaagcaatctgagagatttgaatagaaaaagtaatcaagttaaaacctgcaaagctaaaattgaactacttgggagctttgatccacaaaaacaacttattattgaagatccctattatgggaatgactctgactttgagacggtgtaccancagtgtgtcaggtgctgcagancgtt

SEQ ID NO: 26206 - DNA, 500 bp, Homo sapiens
  misc_feature 20, 37, 63, 87, 94, 197, 230, 248, 266, 276, 305, 310, 356,373, 425: n = A,T,C or G
tggagccggggtaacccggnttttatggcgggggatngcgctctgatatatacttccttcctnttatatgtggcctctgggggcttngccgganccttcctgcagtcagtctaggtttctcttactgcatgtgattaataaagatctgttgggtttatgattaagttttaactcgttttaggaacagaacaatgagngaggtattcacaaaactatatagtatattcctncaattattctgagattgnattatttcacttttcttngatgaccagngtgataataaatgatagtttattttcagngccgnacttagctaaacaacacttgaaccctgtattgttcccaaattatgntcaaaatctacctaagnaaatccaaatgtccatgagcttatgcttaagcagatactggggtctttatgngcctattactcactttcactttaagtatttgacagcatgggcactatttccagcagttttgattaactaaaatct

SEQ ID NO: 26207 - DNA, 415 bp, Homo sapiens
  misc_feature 30: n = A,T,C or G
acccacatgacttattatgctaaagccaantttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacatcc

SEQ ID NO: 26208 - DNA, 433 bp, Homo sapiens
  misc_feature 18, 391, 426, 432: n = A,T,C or G
tatggaccgggaagaaancacactgtattaaaaatggatacacatggtcaggttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgatttttttttttaacatgtattcagattganaaatatgattttaatgcttaaatctcatgtagttngttttna

SEQ ID NO: 26209 - DNA, 465 bp, Homo sapiens
  misc_feature 7, 31: n = A,T,C or G
ggtagtncggaaatggcgtcgtggcattgangggcatccctcctagaaacctccaggaaaagctcgcggaagacgaggttctgcggagagagaggctccaagcagtctgggaagtgtagtccagttggcttagcagtagtttcgttgggggggagcccgaggttcccgggaaggggctaggccggccttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgactttcagtatgctgagacggaaaccaacacgcctagagctaaagcttgatgacattgaagagtttgagaacattcgaaaggacctggagacccgtaagaaacagaaggaagatgtggaagttgt

SEQ ID NO: 26210 - DNA, 440 bp, Homo sapiens
  misc_feature 162: n = A,T,C or G
gagatccgaggacatgttgacgtcgtcccgagagtcttaaaatcctgctgtggccggattccagactcgtgggggaaaggctgtttccaaggcaggaaaggtaaagagacaaagaaagtgccttgtacagatgcaaacggaggtgtagactgtgcagctgcnaaagtggtgacaagcaatccagaggaccatgaaaggatcttaatgcaagtcatgaacttgaatgtgccgatgaggcctggcattcttgtccagagacagagtaaggaagtgttggccacacccttagaaaacagaagggacatggaggcaggaagaggagaaccaaataaatgagaagcaagagcctgagaatgctggagaaactggtcaagaagaggatgatggctttgcagaaaatacacacatctgtcactagaactccttcagttgttgaaggc

SEQ ID NO: 26211 - DNA, 470 bp, Homo sapiens
  misc_feature 112, 376: n = A,T,C or G
atgataaggaaatctttttccttacagtgagttctctggtgatgttgatagcctggaactgggggacatggtcgagtatagcttgtccaaaggcaaaggcaacaaagtcagngcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcncaaactatggcttacaacatcacacccctgcgcagggccaccagtggaatgtgtgaaaagatcagttttggcttcattaacctatgaagtagga

SEQ ID NO: 26212 - DNA, 370 bp, Homo sapiens
  misc_feature 10: n = A,T,C or G
gagctcagtngcccaccttcctgcatcctattggccttattcattttaaatgagttaatgaatctgccagatctgtgaatgatagagattatgctaaattaatgctgattctttgtgtgtgtgggaaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgcaccacttttttgttactgtgaccacggcagaacaatgtcttctaga

SEQ ID NO: 26213 - DNA, 221 bp, Homo sapiens
  misc_feature 10: n = A,T,C or G
ctcccagggnaattcggccttatggccgaggagagagaaagggaataacatccctacctgcaatgaaagcacatctgcaaacaggtgaaaactacaactgactatctgaataacatgagctaaaagacattttttaaatgatacaaataaagagtaacaagccaaaattagaataactcgaaaatgtggtgaagatctcagttgttatttcagaaatgaaa

SEQ ID NO: 26214 - DNA, 184 bp, Homo sapiens
gaaggccgaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaact

SEQ ID NO: 26215 - DNA, 134 bp, Homo sapiens
  misc_feature 3, 19, 79, 101: n = A,T,C or G
gtntcccggggtattcggnctttatggcccggggaactctgggagggagaagtggtcaaagaagctctctgtggaagancagaataaagaagaaatcggtnttatgatgaggatgaggatgaagagtgacaaat

SEQ ID NO: 26216 - DNA, 473 bp, Homo sapiens
  misc_feature 3: n = A,T,C or G
atnattatattatgagaaaagatagaccctatcaagtcttagtagcttcaatttataaaaaattctatattctactttttctgctaatactaaccaatagcagtaagtttcgaaaataaaaataattaggaatatcctaactttagaaatgtttttcttctgatatgaacttaatagcttctgtacaaagaactattgggaaggtcacacaagagatatgacccaggcttaaaaggaaacatgcatcaaggatacattaatataaaacttggaatctagtaagaaaggaaaaaggaaagtggtatattcttaaagtaatgacagattgttggaagagatgatacaaacttttttaaaaaaaatgccttttaacaaatattaaaacctgcaaaatggcacttgtggtgattattctggagaataaacagattacataagattttgtcaggtgacaaatgtacattaattctgca

SEQ ID NO: 26217 - DNA, 495 bp, Homo sapiens
  misc_feature 2, 12: n = A,T,C or G
anttttttgganactgaaatgaatttgcccttttctgccttttcttaagtacctattttgtaactattattgcacctaactatatccaaaacacattctgagcatcactgtgagtaacagccttccagtttgtacccttttgattcacagcatggccctatagttaattaagaggtggataacttaagctcacaactgcctttaatttgatttcacatccacagttataaactttgcatttaaaaggaaaatgagacatttaaataggttcctgttgtttcacatataattggtaaaaacatattcccttgtaggatcctattatcagagcatcaaataccaaagtcagcaactttgggttgccaaataaattaggctcattaattattttgaaaaaggctgctggttccatgtaaatgataattttctttttcatggacaaggtatgggacttatctactaaaagaaacatgcctaacctaggttttatcttta

SEQ ID NO: 26218 - DNA, 110 bp, Homo sapiens
  misc_feature 6, 7, 33: n = A,T,C or G
tcggcnntttattggcccggggttttttaagantcttaggagggatggagttttcaaagcataatacaacttgtagattaaattctgcaaatttgatttcttaaccaagg

SEQ ID NO: 26219 - DNA, 470 bp, Homo sapiens
cagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattg

SEQ ID NO: 26220 - DNA, 211 bp, Homo sapiens
  misc_feature 3, 20, 40: n = A,T,C or G
gantggtgttgaattttgcnaataccttttttgatactanttgagatggttatacttttttctccttttattctgttgaaacagtaatttatgttttttggttttttttaaagcgatagggtcttggtctctcgcccagggtggactacagtgagccaggttcatgccactgcactccagcctgggtgatagagcaagatactacctcaag

SEQ ID NO: 26221 - DNA, 500 bp, Homo sapiens
  misc_feature 2, 16, 121, 123, 154, 165: n = A,T,C or G
tncgggtcttcggccnttattggccggggaaggccagtggaggtgactggtgatgaatacaatgtggaaagcattgatggtcagccaggtgccttcacctgctatttggatgcaggccttncnggaaactaccactggcaataaagtttttggngccctgaaggnagctgtggatggaggcttgtctatccctcacagtaccaaacgattccctggttatgattctgaaagcaaggaatttaatgcagaagtacatcggaagcacatcatgggccagaatgttgcagattacatgcgctactttaatggaagaagatgaagatgcttacaagaaacagttctctcaatacataaagaacagcgtaacctccagacatgatggaggagatgtataagaaagctcatgctgctattccgagagaatccagtctatgaaaagaagcccaagaaagaagttaaaaagaagaggtggaaccgtcccaaaatgtcccttgctcaga

SEQ ID NO: 26222 - DNA, 472 bp, Homo sapiens
  misc_feature 121, 216: n = A,T,C or G
atgctgtatgaggcagagtccatgggtcttctgggcatgaacccctagctaaccttcccacatagccagggcatcccattttgggacacccctaaccacaatccaggatgggcagcactgnaaatgttttggagaactgaggcaaaccttggcttaaggcacccatctagtcctgaaaaggaggcagtgacctagagtaaaggggattcaacaggngaactgcaaagaacctgtaagcaaacacaccctagaaagacaaaaagaagccagccagcaaagactggaataaataactaatccttcaatgtgaagacaaagatgtaagcccaaaggaacaacagcaaacaggaaaccattgacttccccaaacagacaaagcaaggagaccgtgaccagcccttaacaagatggcgatgtgtgaggttttgggatcaagaattcaaaatggcagttttaaggaaattcagtgaat

SEQ ID NO: 26223 - DNA, 494 bp, Homo sapiens
  misc_feature 11: n = A,T,C or G
taattcggccnttatggcggggatagacagctgtggatcataatacctatagactagatatcgttatctacttatttatattaatgacaggatatccctgggcaaacagcatcaccactgtactgtgtattcttggttgtcatgggaacctttgctgtgaaccagcagtgagagcacttccattgaataaagctgcctctggatagccatgagttgcatgaagttattttactaattttatttgccttttacttgaaagcataagtttctgaggatgtaattacagtttcccctatatttctacagaagtagttatagatgatggacctcctgaacttttatcactttgccatactctgtaaaattacctaagagctccagagcatgaaattaacactcaggaatattgtagcctaaccttttttgctactctgaataatactgaattgaagggtcttccacagcaagccctctttaaattatgctttctgatg

SEQ ID NO: 26224 - DNA, 470 bp, Homo sapiens
  misc_feature 299, 425, 427: n = A,T,C or G
gaatccgagaaattagcatggatataccgggacctcatgcagcttggaagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccgcaggaggaacttgaaaggagggtaaaaagactaaaatgagggggaacagagttcacttgtacaaatttgacaactgnccccaaaattcataaaaaacaatagtactgtgcctctttcttctcaaacaatggatgacacaaaactatgagagtgacaaaatggtgacaggtagctgggacctaggctatcttaccatgaaggtngntttgcttattgatattttggggatgaagggaactatttttgac

SEQ ID NO: 26225 - DNA, 390 bp, Homo sapiens
  misc_feature 265: n = A,T,C or G
ctggtactgacaatgttgtacttcttgacttgagtagtagttgcatgggtgttcacttgtcattaatcattcagccgaacatgtttattttgtgcacttttctgtatagatattatattttacaattatggagtttttaaaaggagactttttattggcaaggaaacatattcctgaagtatcatgaagtgaaaacagtttacaaaaaagatgcaaactagaacctcagcgaacattaaaactacaaagacattacatacaaagngcaagaactaaactaggatgctattattaactaaattttatgctattattatcactattaataaaaatcttttaaaatttttattaggagaagaaagacatgaaagagaaatgagtaatatttgg

SEQ ID NO: 26226 - DNA, 182 bp, Homo sapiens
  misc_feature 5, 9, 15, 19, 25, 30, 36, 39, 44, 58, 59, 65, 75, 80, 81,90, 111, 129, 147, 163, 167: n = A,T,C or G
tcccnaaantaaaantccnttagcnagtcnagaaanacnttgcnttcaactaagaaanntgcccnaaccttgccnaatcnntgtttgganctgagcctaaattttgttccntcttttcctgaaacctanttaaagggtaaaaataanttaaccaataaaaaanttcntctttactaaaggta

SEQ ID NO: 26227 - DNA, 418 bp, Homo sapiens
  misc_feature 11, 118, 121, 129, 171, 174, 188, 222, 224, 226, 263, 280,306: n = A,T,C or G
aaataatagantttccacaaacacctcagctgattgtagcagtgttatttaagctggtatgtttattttttttttcttggaaggatagctttatattttggctttcattataaattgngtnctgcttgngtttaaatggcttacttataagctagagcactatatgggagngtncttctctgtatggnatccttttatttgcttggctgggttcataacagngngngccatattctttcttttcactgattctaagccatganacttattagcatctggnggcaagctgcagggaccattaacagngtgtctctttgactacaacgtggatctgccactacgcgctatgtaccattatgtacaatctctatttggctcaacttcgatgaaaaagaaataaatatttgctaaactctca

SEQ ID NO: 26228 - DNA, 258 bp, Homo sapiens
  misc_feature 7: n = A,T,C or G
tcggccntttatggcccggggcttttaaattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaattcggag

SEQ ID NO: 26229 - DNA, 140 bp, Homo sapiens
  misc_feature 20, 31, 42: n = A,T,C or G
gatttttctgattttaagantaacataagcnggtgtggtggngggtacctgtagttacagctacttgggaggctgaggtgggaggatcatttgagcttaggagtttgaggccaggccagcctggttgatgtagtgagaca

SEQ ID NO: 26230 - DNA, 225 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgag

SEQ ID NO: 26231 - DNA, 118 bp, Homo sapiens
  misc_feature 17, 73: n = A,T,C or G
atgggaagtacaaaganttttgacagccctcaaagaaaaactgagagaagctaaaagacaggagtgtgaaacnaagattgcacaagagatagccagtctttcaaaagaggatgtttcc

SEQ ID NO: 26232 - DNA, 208 bp, Homo sapiens
  misc_feature 17, 22, 27, 28, 29, 42, 50, 53, 54: n = A,T,C or G
tggcccgggataggtantgtantgtannntgaaaaaaaaacntagtatantannagggcttggtacctatctgcagtttcaggcatccactcgggggggtcttggaatgtatcccctgtagataaagagggactactgtatttggagacatctagtcataggataaattcctagcagtggtattgccaggtaaaagggtatttgcttt

SEQ ID NO: 26233 - DNA, 166 bp, Homo sapiens
  misc_feature 139: n = A,T,C or G
gaaatgaacccaagcatggattaaagatttaagtgtaagacctcaaactctaaaaatcgtagaagaaaacctaggaaatatccttctcaacatcaaccttagctaagaatttttggctaaatctcccaaagcaattgcnacagaaacaaaaattgacaagggggac

SEQ ID NO: 26234 - DNA, 474 bp, Homo sapiens
gacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgat

SEQ ID NO: 26235 - DNA, 473 bp, Homo sapiens
  misc_feature 246, 305, 424: n = A,T,C or G
aaggctgaaaaaagcagaaaagaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaaattgaaatgtaaggctgtgtaagatttgtttttaaactgtacagngtctttttttgtatagttaacacactaccgaatgtgtctttagatagccctgtcctggnggtattttcaatagccactaaccttgcctggtacagtatgggggttgtaaattggcatggaaatttaaagcaggttcttgttggtgcacagcacaaattagttattatggggatgggangtttttttcatcttcagttgtctctgatgcagcttatacgaaataattg

SEQ ID NO: 26236 - DNA, 468 bp, Homo sapiens
  misc_feature 461: n = A,T,C or G
accaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggnttctgca

SEQ ID NO: 26237 - DNA, 466 bp, Homo sapiens
tctccgttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatact

SEQ ID NO: 26238 - DNA, 461 bp, Homo sapiens
gcgcatgggaattggagagaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctggagagccacatcctgttgactgaaagtggcatgcaagataaatttatttgctgttccttgtctactgctttttttccccttgtgtgctgtcaagttttggtatcagaaataaacat

SEQ ID NO: 26239 - DNA, 467 bp, Homo sapiens
ttgaaatgaaggaaaaaatgttaagggcaaccagagagaaaggttgggttacccataaagggaagcccatcagactaacagcggatctcggcagaaaccctacaagccagaagagagtgggggccaatattcaaaattcttaaaggaaagaattttcaatccagaatttcatatccagccaaacaaagcttcataagcgaaggagaaataaaatccgtcacagacaaggaaatgctgagacagtttgtcaccaccaggcctgccttacaagaactcctgaaggaagcactaaacatggaaaggaacaaccggtacgagccactgcaaaaacttaccaaattgtaaagactatcaatgctgtgaagaaactgcatcaactaacgggccaaaataacagctagcatcatattggcaggatgaaattcacacataacaatattaaccttaaatgtaaacgggctaaatgc

SEQ ID NO: 26240 - DNA, 439 bp, Homo sapiens
aaccgatgttttcttcaatggtttcaattgtctgttggacacaacggagctgagaaccattttctttcaaagagctgaagaatccttttaccttgtgaggaaaaagtgggttttaaaaaattaattttatcacattaatcagatgtaactttagttaaaactgaagccaaaattccagcatttgtcaaaattctatatagaaggcagtcccagctgtctgaataggattatgtacacataagctgtatgaaatgagctcatgcctcatgatgtcaagttctgttttttgtctgcagttcttttgtttattctcagttgccagactttaaaagacttcactgtttaccattttataattaaggtttaattgtgtctatttaatgtgttattctgttctgttctcacagatgtaaaacttcgttttttaaaaacatgatat

SEQ ID NO: 26241 - DNA, 469 bp, Homo sapiens
  misc_feature 4, 5, 118, 148, 163, 303, 354, 400, 449: n = A,T,C or G
aggnnagactttatctacttcatctgttcctaagtaagcatgttagttctggggaaggatcataagaaaggaaatactttttaaaaaaaaatttggaaacatgtaacaaagcaagggnaaaatatatatatatatctatataagggcngggactggtaaaagngtactttccattaattattagccgagttaagagaatggtcacattgaagtactgtgtggactagaaatgtaccctgtcatcatgcaatgaaatattgttatcgttttaacatagctcatttatgtagaatgaattctggnggtttaccccaagtcacagttaggacggtagatggtgagatcgcagatgcnctattatctagattcagtgttacattttcgatgtttatcactcagngggtttttattaatatgctgattaagttatttactgggccagtcattgngctaaataggtgctcttttg

SEQ ID NO: 26242 - DNA, 468 bp, Homo sapiens
  misc_feature 5, 11, 12: n = A,T,C or G
agganaaagannataaaaggctgtgaaaataggagatatcggtttttggaagttgcaaaccagatggctatgtggtacctgactttacagaccacaggctttcctgaaatatcagtggttgcaggcaaaagataccaatggggaataaaagtttagtactatagaaccccagaaaggcacaaatattgggatgaccaagtgcattaggaggtagaacttaaaataagggggtatgttgaaagtttgtataaagagaaaatgagatggaataatttttgggagacaccaacccacagggttcttggacttgaaaacactaagcacattaaaaagtaaacatgaggtggctagactgaaaataaggtgattaattgagtctgtatccagaatagtgaggtttttcccaactcttcccctgctccagcaacaaggcttatgtctctatgttacttgcttagaggatccttc

SEQ ID NO: 26243 - DNA, 463 bp, Homo sapiens
atgacaaggaaacttacaaactgcaacgcaggagaaaactattaaaggtattcagaaacgtgaagccagcaattgtttcgcaattcggcattttgaaaacaaatttgccgtggaaactttaatttgttcttgaacagtcaagaaaaacattattgaggaagattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatggtacatgtcaccttaggtagtaggaagaattacaatttctttaaatcatttatctggatttttatgttttattagcattttcaagaagacggattatct

SEQ ID NO: 26244 - DNA, 133 bp, Homo sapiens
  misc_feature 3, 102, 107: n = A,T,C or G
ganatttgcttctgacacaactgtgttcactagcaacctcaaacagacaccatggtgcacctgactcctgaggagaagtctgccgttactgccctgtggggnaaggngaacgtggatgaagttggtggtgagg

SEQ ID NO: 26245 - DNA, 100 bp, Homo sapiens
  misc_feature 96, 97: n = A,T,C or G
attcggcctttatggcgggggaagggggacgcgagataaggtcctgatcagaaatcatggtctcccgcagtgaagtggacatgttgaaaattaggnntga

SEQ ID NO: 26246 - DNA, 100 bp, Homo sapiens
  misc_feature 4, 15, 81, 91, 94: n = A,T,C or G
cccngggtattcggnttttatggcggggtttttttgaaaaatttaacaaaatagatagaccacgagccagactaataaagnggaaacgagngangaatca

SEQ ID NO: 26247 - DNA, 489 bp, Homo sapiens
  misc_feature 11: n = A,T,C or G
atactacaagnatgaatatgtagtcatgtacctatattgaatcacattcttttttaaccagtaactgatttaaatattcaatttataattttgaaagtgccatgatttccgatcagaatatttctggatctctgaaaaatagcaaactatacttctttgataccatgacacactttttatttttcacgtgttttaacatctctgaaatcaagatgcatcttacaattaacgtcatcttaaaatcactgttcgccggatagcagctgtgactcttgatgttattgtctatttgatgaacttggttgttattcctggccacatgaaaggtcaactaagtcctcaactggctatcaggaaaacatttaaagatcacttgaggaaggaatattatccctgagttgtgatccgaaaaccttcactggcaccttctgatgaagtcaaaaaagtgccccgaataaaaaactggccaggcagtgcctcatacctgtc

SEQ ID NO: 26248 - DNA, 431 bp, Homo sapiens
gaaactacccaaatttttaaaaatggaaacaggttttaataaacatttcactaataaaaatatacaaatggctaatcaacacatgaaaatatgctcaatatcatcactcgtgatggaaacgcaagttaaaactgtaagaagatataccatacattcactaggatggttaaaattaaaacatctggcaataccaagtgttaaggaagttggccagaaccctcatatgttgctagtgagagtgtgaaagtggtacaaccactttggaaaatagtggcagtttcttatgacattaaatttgtacttgtcatatgacccagtaattccaggtatttataggcatctacccaagagaaataaaagcatatgtctaaacaaagacttgcacctgaatattcataaagcttttgtgataggctgagtaatgcctccct

SEQ ID NO: 26249 - DNA, 433 bp, Homo sapiens
agggaagagagagggtgggggagaaaatgtttttttctaagattttccacagatgctatagtactattgacaaactgggttagagaaggagtgtacccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatgg

SEQ ID NO: 26250 - DNA, 464 bp, Homo sapiens
  misc_feature 9: n = A,T,C or G
gcaccatgnaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagct

SEQ ID NO: 26251 - DNA, 400 bp, Homo sapiens
atcttatggtaaagaattaacagttctaatagtgtaataacatcatatttgctcttcatttgaattgtcataaaagtaaaattataatttattacagacatttcggtacatcatccccttaacagtttaaaaggtctgttattataatctcatagagtaagacattggaagttaagttgcttatcagggaatagaaaatgtgagctaaacaatgcagtatgtaaagttccttgttgtagatttcctccccattaacttgccgataacaggacattacattttattcctttaaaacatggaaattagcatatttaaaccatagctttatcctagggcataatttcagtgtattgttattaaccccaaactctgagttggaagaaaacaaactgcagactgg

SEQ ID NO: 26252 - DNA, 489 bp, Homo sapiens
  misc_feature 5, 488: n = A,T,C or G
gcccnagaaaacatatgaagaatatggatatgatgatacataccgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaaagng

SEQ ID NO: 26253 - DNA, 116 bp, Homo sapiens
  misc_feature 41, 47, 58: n = A,T,C or G
cgctcgaaatggaccccaactgctcttgcgccactggtggntcctgncgtgcgccggntcctgaagtgaaaagagtgcaaatgcccctcctgcaagaagagctgctgttcctgctg

SEQ ID NO: 26254 - DNA, 431 bp, Homo sapiens
  misc_feature 5: n = A,T,C or G
aaggnaggggaaaaattaattttatttggggttcttgagatatctatgctgttctttaaatctacagcaggggtaaacattcatctgcagtgtgcatcaatttaaatcatatatcctaaactaaaagcacaattcatacttcgggaatattttataagtaatatatctttaaaagaaaattaccctttgacttttataatcaatataagttccaggcccagtatggatttacaaaatctgtgtcagttgtacaccatgaaaggattactttcattctcatgtaagggcatgcttttataaaaaacaaacatgggctaggcgcagtgacctcacgcctgtaatcccagcaccttgggaggctgaggcgggcagatcacgaggtcaggagattgagatcatcctggctaacatggtgaaaccctgtctctact

SEQ ID NO: 26255 - DNA, 244 bp, Homo sapiens
  misc_feature 3, 27, 49, 196, 226: n = A,T,C or G
ggntgtggagtggatgctttggcaagnatggcggggagcggcgtccgcnaagctacttctaccgccagcaccttcgtgaagcccattttcagtcgggacatgaacgaggccaagcggagggtgccccgagctctaccgcgcctggtatcggggaggtgccgaacactgtgcaccaattccagctggacatcactgngaaaatgggacgggataaagtccgagaaangtttatgaagaatgccca

SEQ ID NO: 26256 - DNA, 467 bp, Homo sapiens
aggaaatcgtggagaagcatagaaactataaggaaaaaaaaacaaaaacaaaaactaaccttagggagatagattcctaggcaaggcttacctgctgtgagatgaaaaaaagcctactagttacttggaaatgtttttcccaataaggaaaaaaatcccttctcttgtgttacattgcctgcaaattctagataactactttagctagttatctagaatagataactagataattactttagctgagcaggcatactatttgaaagcagtaaaacatgtgtcctagagctattgggccattatattttttttgtgcttttaatcaatttcactgagatcaatggcagtaaggcagtgagtatgtgtgtgagtaaattaaagattgctagtttgagactattgagcctttagggtggtgggacaagactggagggggtcctcagttgaagaggtagtggagaagacac

SEQ ID NO: 26257 - DNA, 378 bp, Homo sapiens
aggttattgtaagattttgtttggagagtttagagtgtatgtatgcatataattgttgataaatgtttattgacattttggttaaattaagcaaaattgaatattatgtattatgtgtgggactcttagaaaagctatatttttgaggataaaaaggtcctgaagtaatataaggaagaattttttgaccaagtagatgctgcttggagtaatggattctcaaccatttgtgttacttaagacctaggaaattttggtgatgtcatgaattagattgatgcattggctgtaggttagattaaatggtttttacagccaaagtttggatatttcgatcttaagaaatgagaaagatgagtaaggaccaaaccttaaggg

SEQ ID NO: 26258 - DNA, 466 bp, Homo sapiens
  misc_feature 206: n = A,T,C or G
gttgttattttgatattagacactgtgcttccgctgactgtccacatggaatccgtgggcttacaaggaagacattcttcagaggaggctatctgttctccggcccacttcctaagagaaagcatggaaattttaaggctctaatcctacaacacatggatgcaaggacatgcacaaacacacagcgtggtcaatttgcttcactnggtcgatatatttcactgggagtttagcacgtgtttccgtggacttttttcattgtgtgatcttcaatgctgatgtgttgacttggacaaacacccggagacttctctagaattccaatttgtgcaaaaatgaaagggctgagaaacatgattggctagtggacttgtagagaataaagtaggtttgtatgctatagagagaggaaagatcttcagatcatagaactctgtaagaaaaatccaaccacagagagaacaca

SEQ ID NO: 26259 - DNA, 467 bp, Homo sapiens
  misc_feature 440: n = A,T,C or G
gagtgcctttgagagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggngctttgcctttaactagagtgtgtgat

SEQ ID NO: 26260 - DNA, 481 bp, Homo sapiens
  misc_feature 1: n = A,T,C or G
ngagagaggacacttccggtctcctagtctgaggttcctgctttaatgaccggggtagtttgagccatttctgcgtcttgaggacattttgaacgaaccccctttgcttgaggctcgaaccacccgatgatcgatgatcgtctcaggggaaaagaagccttggggaagagcaagaggtttagaggcacaattctgctttccctggaactgtgtcattcaggactctgcaaattccctaaagtaggaggaaaaatgaccatgtccaaggtaagtaggacttgcctctcttactgttaaaattccatctctactaaaaatacaaaattaactgggcatgggtggtacattgccttgtaatcccagctactcggtaggctgaagcaccgagaatcactttcaaaccgggagccggaaggttgcagtgagctgagattgggccattgactccagcctgggcaacaaggagtgaaactctgtccca

SEQ ID NO: 26261 - DNA, 468 bp, Homo sapiens
  misc_feature 400: n = A,T,C or G
gttgatcagcccattatttggtctaacgttttttcttttatcattctgaaactgggtttatctaatacattgataaattatttcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtcatatatttaagaaaacactaaaaagaatggaaattgtatgacaataacttaagtctttctccaaagtgcatgcagtcttttgcgatacctnattcagccgagtatttgtactcttcctcattcagtataaggaagctttcagtttgcttagaaggcaac

SEQ ID NO: 26262 - DNA, 468 bp, Homo sapiens
gttttaatgcttgcgtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaggtttgacataaagagcttctgcaagatcctggggccattatcctactccaagatcaagcatttgcgtttggatggcaatcgcatctcagaaaccagtcttccaccggatatgtatgaatgtctacgtgttgctaacgaagccactcttaattaatatctgtatcctggaacaatattttatggttatgtttttctgtgtgtcagttttcatagtatccatattttattactgtttattacttccatgaattttaaaatctgagggaaatgttttgtaaacatttat

SEQ ID NO: 26263 - DNA, 279 bp, Homo sapiens
aataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgcg

SEQ ID NO: 26264 - DNA, 204 bp, Homo sapiens
  misc_feature 11, 16, 17, 125, 128, 169, 185: n = A,T,C or G
agatcaatagnagcgnnaagagatcacaaacaaacaaaaggaggcgtgagcatttggcatatgacacaagtcatgggaaagggagaagaagtttaaacaaatatgatgtttagataattgcctanccntttagcaaaaaataaattaaattcttgcctcacgctgggtnccaaattgaattgagngttgaataatcttgctatg

SEQ ID NO: 26265 - DNA, 465 bp, Homo sapiens
  misc_feature 51, 54, 198: n = A,T,C or G
atagtaaagattccttttatgctctccttttagctacttggcttctggagngtnactctgttttcctaaatttacagtagctgccagtcttgtgctgagttctcctccaagtacactgaattgtgcaattcttgcttggcccagttttggacaggcatctttcccagaaccaagtggtcttctcagaggttaaacagntttggcaaaaactgtaaataatgactgaataaaaccataaaaactgaaatcagtcaggaaaaagatgattcctgactgcaagccacatggatgcagaggacccatttttttaaaaaaagtttgtttctctattcaagccttcttaagtttgatcattcttatgatcttctctttgcctcaaataaacccccccatttattgtgccttttatgactcttgattcctgttggcagtggtaaggaataggaactataactactgtttctt

SEQ ID NO: 26266 - DNA, 412 bp, Homo sapiens
  misc_feature 104: n = A,T,C or G
aatggagcaaaacagtctttgaatatcgaacacgcaaggctgtgagactacctattgtagatattgcaccctatgacattgggggtcctgatcaagaatttggngtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggggctataataaataaacttcaacactctttatga

SEQ ID NO: 26267 - DNA, 178 bp, Homo sapiens
  misc_feature 17, 34, 73, 140, 153: n = A,T,C or G
gagttggactgtgaagnaaacatggcggccggangttgacttcgaaattgtactccctgctgttccgagcacntcaccttcgccctcaccatcatcgtgggcgtcatgttcttcgagcgcgccttcgatcaaagcgcggncgttttctacgancacatcaacgagggggagctgtggg

SEQ ID NO: 26268 - DNA, 458 bp, Homo sapiens
gagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaat

SEQ ID NO: 26269 - DNA, 431 bp, Homo sapiens
  misc_feature 2, 24, 40, 120, 308, 425: n = A,T,C or G
angttttatatctatgtccaaagnaccccaactgataagnattcagtaagttctgctacttcaatataacaattcatgatactgctctgttgaataatgcatttatagaatagctgtgcncttatgtctatggaaataaaacaataaaccacaaattcacagcattcctttttttctttcttgacaagagtagagattgcaacttttatctctgcaatatcttccttctgttacatttggtaatatgaaatctgaagcataattatcttccactgtgacttttaggtatttttcttaaatgctgtaancctcagctttttaatctatagaaatgtcaatgataattgtacctaatctcaagggtaattgtgagaagtaaatcaagtgatggatgtaaagcacacaacattaggtttggccacagncggcac

SEQ ID NO: 26270 - DNA, 476 bp, Homo sapiens
  misc_feature 402: n = A,T,C or G
gtgagtaaaatttagaaatggagaaatgtgaagaaaaaaataaaagcaaagatgtatggagtgaaataatgaatgcacattttcccctaagaaatttccgtagtattctgttgacctagtagttcatatgtgccctagttttatgattaatgatctgaaatcattctggattgaacgcatattaccaacttctaaaaaagtttttattaatattttcaaacataaaagagtaaaatgatacactttcatctgctggcaacttggatagatttaacagttatcaaaatgttgccatacttgattctttttgtctttttattcccaacgcatttccaaacaaattcaaaacttaatatcatttcacctctatattcttcagtatgcaactctaaaaatatgggntattttctcatataatcacaacgttattatcatacataaaatatacagacattttccttgttaccatctaatac

SEQ ID NO: 26271 - DNA, 100 bp, Homo sapiens
  misc_feature 6, 9, 10, 12, 13, 17, 19, 21, 25, 35, 39, 43, 50, 68, 69: n = A,T,C or G
caacgntcnngnnattncnancaanggtaaaaacngcgngctnacatcgnactctcaacgatgctgannaagaaaacatgcagataataccctgaccttc

SEQ ID NO: 26272 - DNA, 293 bp, Homo sapiens
agagtttcattttgacttgaaggctcacgatattaatagatgcgtttgacaatgccattatttgaagctcacacatttttgaagtgtttccaaatcagatatgtaaatgtaagagtgacggaaggggaaaaacctatcacaaatgaataaacttgcatttttgtagttaataaaagatcgtctaactttgtcttacttgttataaattcagatattaatgttatgagagatgattctgtagctaagcagtaaatttgacatacctggattattaaaaccatgcttcttgccag

SEQ ID NO: 26273 - DNA, 133 bp, Homo sapiens
gagaccttgtcttaaataaataaataaataaaattttaaaactccagtcatttcatctgctgaaggggacggctactgtaatttttgtgtgtcctttagattttctttctaaacagagacagggagagggagg

SEQ ID NO: 26274 - DNA, 390 bp, Homo sapiens
agatagtttgtataacataaaacataacaaatacagtagaaagcatatggtagtgggattgaagaaacccgagaggttatttatcccaaacaccacctgatgttacagtgcttattgagtgattgatactgtgtcctacgtagagggggcacataaacaattcacatgtaatttttctgtattacattgacagatatatataaaatgatctctgcatctaaaattcaagcagtccagcctggaatactatcaccaaaaagtgaaaactgattttagaaacgaataatatttttgttgtgaacaactctgaaaacatactggtcgatgaggtttatagctagagtctaaaatgccacatttatatgggtgaaacattttcagcttcaggag

SEQ ID NO: 26275 - DNA, 411 bp, Homo sapiens
gactggattgacagctaaagtatcagaatgaaagcaaggtttttttgatgttacctgactgtcataaagatgaaaatgatttgcattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagg

SEQ ID NO: 26276 - DNA, 446 bp, Homo sapiens
  misc_feature 328, 373, 377, 385, 420, 438: n = A,T,C or G
ctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcatattttaaaaagaactgtactgtaaatggaatgcttgacttagcaaaatttgngctctttcatttgctggtagaaaaccggaattaacaaagacagtnatgnggaagagngcattacactattcttattctttagtaacttgggnaggactggaaaatttttnaacatctt

SEQ ID NO: 26277 - DNA, 470 bp, Homo sapiens
  misc_feature 18: n = A,T,C or G
gagaaagtacactcgagnaaagctctaggtaaaaggtaaagtagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaatgacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaagg

SEQ ID NO: 26278 - DNA, 152 bp, Homo sapiens
ataattcgaaatgaaaatgagaaatgatttctgaaatagatttcaaaagcaaagatttagagtaagggtagccaatcttttcagtgctttatgtcatcagtaagaccctgcccatggctaatgattgatggaggaaaaaaaaaccccagacg

SEQ ID NO: 26279 - DNA, 470 bp, Homo sapiens
ctgccttttatgttttgttaaagcatgtaagtggagatcagttgtgccttagttttgcttttgtattaaaaatatcttttatctaaaaaatgagtaatagctaagcataagtaacataaaaggttttctttttgtagcttttaattactttattataagtatagaaaagaaggctttatatgccatttttagccttcctgtattaatactgtcctcctggtttttaagatgctgtttgacctatgaacccatatcctttagtatattaactgatagttttagaatttcctaggtgatgaggttgggccgttcaagaccagcctggccaacatggtgaaaccccatctctactataaaaattagccgggtgcagtggcgcacgctttgtaattccagctactcaggaggctgaggcaggagaattgcttgaacccgggaggtggaggttgcagtgagctgagatcgtgcca

SEQ ID NO: 26280 - DNA, 362 bp, Homo sapiens
  misc_feature 146, 322: n = A,T,C or G
gactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcngtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcacctctgtatggcttcnggcggcttgaatctaagaatacgcggtctcctgagaactt

SEQ ID NO: 26281 - DNA, 384 bp, Homo sapiens
  misc_feature 5: n = A,T,C or G
ccagnaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgct

SEQ ID NO: 26282 - DNA, 487 bp, Homo sapiens
gggcccaagtaaaaaccacatattcccccttctgatcttgactattttacctttgatcccctttctaattaggatataatggacaagtttccatttgcatttatatttaatacataaacatttttgttttcagggttattttgaattaaggttttacgactgcttataacaggggaatttgtttttcagttggattattatttagaaaatgagttactcagtatacattacaattttacactgtcatcagtgaataataaccaggaaaattagttattagtgctatagtagtcttcctgtagacatattgttttaagaagtctttaaatatttttgagtgaatatgtcttagtattacttaacaatgtttcatccttattaagtgcagttattttgttcaacagcagtcagtggaagagcatctgcaatgtcaaacactcctacccacagtattgctgcatccatttcccaacctcagactccaact

SEQ ID NO: 26283 - DNA, 213 bp, Homo sapiens
gtcttcatttccggaatcatctcttcttttgatcactgttcctgattgtgacattgtgcaagtgttaaattgtgtgccttttgttcctgaagaaagaggtatggtaaagattgaaatactggagtatatagtctattaagtagtaagttggtatgttttaatattggactaaataaagtaaaatataggttaagtatcccaaatccaaaaatc

SEQ ID NO: 26284 - DNA, 472 bp, Homo sapiens
  misc_feature 42, 384, 433: n = A,T,C or G
ctgtacgaaaggacaagagaaataaggcctacttcacaaagncgccttcccccgtaaatgatatatatatatatacatgtatatatgtattctcaaatatatatgaaggatatatatatttgagtatgttggtaggggttcaaacataacttcttgtgtatgtctgaaacattggtaaaaattcctggtctaaatttattttgtagacttaaaaaaaatgaaacgttttaaatatgtgaaacttacagctaaatgagagctgatgcttcttttccagttaatttaaaagtattaagaaatgattgatatctagaatggcaaaaaaaaaggtgtcaggatgtatataccttttaaaatttcttagtacccttttctggttgtggnggatttgtggacaacatgtttttatttaggtgattggagtctttaaggnggcagttaaagagcaattatgaagggataagaatggtat

SEQ ID NO: 26285 - DNA, 471 bp, Homo sapiens
tcacttgacaggttcagttggagacgatcataggtggctgctgtgacaaagggaaattgtgcttttccagcatgcttactgaccctgatttacctcaggagtttgaaaggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggtaggtttctcatggtttattgtgcctacactcactttttgaccagtctactcctctaatagtttggcctcagtcctttgctttataattaacatctacttaagaacccatgcacaagattcacccctgg

SEQ ID NO: 26286 - DNA, 104 bp, Homo sapiens
  misc_feature 10, 15, 49, 80, 84: n = A,T,C or G
aagtaataanaatanctaccgccatagacatttaaccttgggtcatttnacacatttactgactctgctaatgagggtanccgntaactgttgctcccagatca

SEQ ID NO: 26287 - DNA, 359 bp, Homo sapiens
gaacatcaagagcggaaaatggactcattagggaggcaggcagtcattaccactcacactgtacttccagggagacaccgattataagaagagaaactcagcgctggggaagaagacaaataaaaagaagtgttaagaattgcctttgggactctgaaggctgaagaattgatgaattgcaagtttgtgccccatagctgcacagactgcctgaagttacatttagagactgaaatcactgcaccttaaaaacaaaagattgagctgcactgtattcctaatgtttcatcattactaacaggatattcctcatgacattgctgtctggtaagtaactctcattatctctaaatggcagt

SEQ ID NO: 26288 - DNA, 207 bp, Homo sapiens
  misc_feature 1, 10, 18, 63, 100, 160: n = A,T,C or G
naatccggantgcccaanatggcggcggccgtaaggtgcatgggtagagccttgataccatcntcaaaggcatagcctttccaagaatggtttatcagancatcacttttgttcttgttctgtaaacatccgagtgccccaacagacatttttgctgctnctacaaagtctgcaaagaaaacaaaaaaaggtgctaaagaaaaaacc

SEQ ID NO: 26289 - DNA, 471 bp, Homo sapiens
  misc_feature 458: n = A,T,C or G
gccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgattattagatgcctcaaaaatcaacttttacatatttgccttctgaactttgttttgacctgtatcctttatttacattggggtttttctttcatagttttgggnttttcactcctgt

SEQ ID NO: 26290 - DNA, 467 bp, Homo sapiens
  misc_feature 387, 399: n = A,T,C or G
ataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaagcctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagnacaatcatttgngctatgtttttaattttctaaagcaccttgatgacagtgagtgtccagtggtgaagcatcctctattg

SEQ ID NO: 26291 - DNA, 466 bp, Homo sapiens
gaagacaagctgtcctgagcccatacctaatgaatttgtgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatagttaaaagcaagttgagacaaaccaggcagattcagtgtgtggaacaggaaggatgtgctttaaaaaaaggtggaatccctcaaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggag

SEQ ID NO: 26292 - DNA, 106 bp, Homo sapiens
  misc_feature 52, 61, 66, 89: n = A,T,C or G
gaggcattgaggcagccagcgcaggggcttctgctgagggggcaggcggagnttgaggaanccgcngataagtttttttctctttgaangatagagattattccac

SEQ ID NO: 26293 - DNA, 471 bp, Homo sapiens
gaataacaaaaaagttaacaaagggatgcaaacttctggataaatcagataaatggtgctacagaggaatttagttatttcagcttaattatttgtaaaaataataatcagtgactaggtaaagatactgaaactcaagaaaaatatcttgacccatttatgtctagtgttccattattggaacgctaagcttatgggagttatttagagcctactgctcaaggtcatcaccaaggtctggttgcaaaaattcaaaaaattgcaacctcaggcataaatggcttaagcccaagagatggcactgaccataaatggtggcttgtgtgtgaagggtttggacttcaagatatactaacacctagaaaactaaaagtgcaattgacccccaattactattttagtttgaggtatcaagggcatttgccaatctcttatatgtagcttctagagttgtgctgtccaatattatat

SEQ ID NO: 26294 - DNA, 383 bp, Homo sapiens
gaaaactaccgtgtgtgtgtatgtgcatactaaaataaatatttccaaagcactattgcctctgcaaaattatgataagagtaaaaatagtggactgccactggaaaccccaagagcaggaaatttataatagaggattcatgctggaagtattaaaggttgtttatagacctaagtggttaataaggatgtgtgtattgatattgctttagttaactccaacttgtaaccaattttattagcaataaagtactcacaatgacttagaaaactcactgacacatacgaacttccaagcatcacacctactacctaggtaggaagtacctacctacttccaagcatcacaccactctagtgactaaaattcataaagtaaaagg

SEQ ID NO: 26295 - DNA, 291 bp, Homo sapiens
  misc_feature 74: n = A,T,C or G
aagaagatcaaagaaggaaagaagaaggggaagaaaagaaggggaagaagatcaaaacccaccatgccccaggntcagcagggagctgctggatgagaaagggcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatc

SEQ ID NO: 26296 - DNA, 201 bp, Homo sapiens
ctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaagtcttttatctgtgcataataaaaagatatatatcagtt

SEQ ID NO: 26297 - DNA, 473 bp, Homo sapiens
agacaagagcagagctttcactggaaatttcaaacaggtgggatcaacattctgaaggatttctttgaagaattttaacaataaatgaacatggttttaccagtacatcctgaagacaaagtacaatcaaatcactggctaccaagagttggaagtgagagcagaagcagactgatcaagaacaaaggtcatggcaacactttttttgggatacgcaaggcattttgctcgttgacttttgggagggccaatgaatgccaacatctgcttattgtaagagtattttaagaaagttagctaaagcttgagcagaaaaatgcctaggaaagcttcaccagagagtccttctccaccatgatagtgctcttgctcattcttctcatcaaacaaggtcaattttgggatagttttgatgcacatttattaggcatccaccctacagtcctgatttggctccttctgacttttttatt

SEQ ID NO: 26298 - DNA, 488 bp, Homo sapiens
  misc_feature 21, 374, 440, 462, 484: n = A,T,C or G
ctctgaggacatctttttctnaccttcattctcagtgatgttttttgcttgtagtatttttagttgacattgttttctgttcagcagtttccttttagcttacgtatttcctgatgagaaatctgcagtcattcaaattgttgtttccctgtatgtagtgtgtcatttttctgtcagatttcaaggtatttttctttatctttagtttttagccatttcattatgttggggatgagtttccttgttttattccctttggaatttgctccaattcataaatttgcagttttatgtctttaccaaacttagaggttttcagcctaatttctaaaaaacttttataagcctgattttcatcttataggaaaaggttnaagggatgacaagtccaatagctaatatgccccagaaggccttcaaaataagaatttgaaagaatncagaaacaactttatatcctcncatggctccacggaaaaatcanatgc

SEQ ID NO: 26299 - DNA, 472 bp, Homo sapiens
  misc_feature 49: n = A,T,C or G
atagtactatgttttaaaatgtattaaaataccatctgttaacattgtnaaattaatttttttaattattatttaaagtaaaactgtcagaaattctaaatagatcctgcatatagataattggcattaaaataaatataattaaatgaaaactagtatcattataatttcaggagtctaataaagctggtcttggatggctgccaaacgaatgtgtcaaagaacaggaaaaaggcaatgataatgctgagcttttgactggaagaaatagtgacagcacttgcctcttatattagttatggaagccaaaagagtagaagagacttggcaaagacaatgaggacttgatttgaggtgacagggaaatggcctgatagaatgtcagcaaagcagaatgaggagggtaccagctggggtcctgaagacctggctctggtcctgccttcactggtcattagtaggctgaccttca

SEQ ID NO: 26300 - DNA, 361 bp, Homo sapiens
  misc_feature 272: n = A,T,C or G
ataacagtcctttttttatatattggtgtaaacataatattcttcaagcaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgctncatgttatttaaccagaaatgtcttatctctaaaaatttttagtagtaattatttaccaaacttaaaaacatttctataaatataaagc

SEQ ID NO: 26301 - DNA, 475 bp, Homo sapiens
  misc_feature 434, 469: n = A,T,C or G
tggtggaagcctttataccatgtaaaacgaacaaaagctataaagcagggctttcttttctttgcctttttcttttttccccagagagtaaatttacctacacaccactgggcatggccctggagtgttagaattcttgggttacttgaaaggcatgatttgaaatcctggagctatattggactgtaatgactggggagcaaatctttttggaaactggttttccaattctttgctttcaacaaagttgaaagagtttctagtgaagacagccgatagattttttaatgtgacttttgaatataccagaaattcaaatagttgaataacgttgctataacaaaactctttccaatctcatgtagttgttacatgaacagccctcctcagagcttatatccgtaaagataaaaaacaagaatagactcactggngaacactagttccctctagcattatggaggttttnatttat

SEQ ID NO: 26302 - DNA, 445 bp, Homo sapiens
  misc_feature 75: n = A,T,C or G
aactacagaacagcctgtcaccaccacattccctgtaaccacgggtttaaaaaccaccgtggccttgtgtcaacnaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccat

SEQ ID NO: 26303 - DNA, 210 bp, Homo sapiens
atcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttttt

SEQ ID NO: 26304 - DNA, 162 bp, Homo sapiens
  misc_feature 6, 35, 37, 60, 70, 71, 83, 85, 149: n = A,T,C or G
gccgancagccgtggtgcttgggaggtttggaaancnttaaaagtgttaaggggccgggngtggaggctnncacctgtaatcncnagcacttttggaaggcccgaagaccaggcagatggcttgaggtcaaggagttcaggacccagcnctgggcaacatgg

SEQ ID NO: 26305 - DNA, 171 bp, Homo sapiens
  misc_feature 4, 19, 32, 33, 40, 41, 43, 46, 51, 52, 56, 64, 86: n = A,T,C or G
tgangaatctggagaacgnccctagatgtatnngggaganngnganggaannagangaggaatnggagaaagagaaggaaagaganaaggaaaaagaaaaagcaacagggaaaagaaggaagaagaagaaaatggagaaagacctagaaagaaaagggagaaagagaagga

SEQ ID NO: 26306 - DNA, 155 bp, Homo sapiens
  misc_feature 64: n = A,T,C or G
tcgaatgaaggcccctaaaaaattgtatacccgcagattcaggcatggattccgtgaaggaacnaacaccctaaaccccaagagggcagctgttgcagcatccagttcatcttaagaatgtcaacgattagtcatgcaataaatgttctggtttt

SEQ ID NO: 26307 - DNA, 316 bp, Homo sapiens
  misc_feature 16, 94, 249, 260: n = A,T,C or G
ctcactcatgtggaanctaaaaaagttgatcttgccaggcatggtggctcacgcctgtgatcccagcactttgggaggccgaggtgggtggaanacctgaggtcgggagttcgagaccagcctggccaacatggtgaaaccctgtctctactaaaaacacgaaaattagctggatgtggtggtgggtgccctgtagtcccagctactcgagaggctgaggcaggagaattgcttgaacccgggaggcgnaggttgcaagngagccaggattgcgccattgtactccagccagggggacaagagtgagactttgtct

SEQ ID NO: 26308 - DNA, 316 bp, Homo sapiens
ctcactcatgtggaaactaaaaaaagttgatcttgccaggcatggtggctcacgcctgtgatcccagcactttgggaggccgaggtgggtggaacacctgaggtcgggagttcgagaccagcctggccaacatggtgaaaccctgtctctactaaaaacacgaaaattagctggatgtggtggtgggtgcctgtagtcccagctactcgagaggctgaggcaggagaattgcttgaacccgggaggcggaggttgcagtgagccaggattgcgccattgtactccagccagggggacaagagtgagactttgtctc

SEQ ID NO: 26309 - DNA, 463 bp, Homo sapiens
  misc_feature 114, 295, 403, 458: n = A,T,C or G
aatgctgagcaagcagctactcagttgaaggttcaactacaagaagctgagagaaggtgggaagaagttcagagctacatcaggaagagaacagcggaacatgaggcagcacancaagatttacagagtaaatttgtggcccaagaaaatgaagtacagagtctgcatagtaagcttacagataccttggtgtcaaaacaacagttggagcaaagactaatgcagttaatggaatcagagcagaaaagggtgaacaaagaagagtctctactaatgcaggttcaggatattttgnagcagaatgaggctttgaaagctcaaattcagcagttccattcccagatagcagcccagacctccgcttcagttctagcagaagaattacataaagtgattgcagganaaggataagctgataaaacagactgaagattctttagcatgtgaacgtgatcgtntaaca

SEQ ID NO: 26310 - DNA, 464 bp, Homo sapiens
gactcggggacctggagctgacgcctagtacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggct

SEQ ID NO: 26311 - DNA, 464 bp, Homo sapiens
  misc_feature 14, 456: n = A,T,C or G
aacatatgaaattnagttaaaagaatgtgtgtttcataatgacttttaactggtaaaaatattacttgcacgaagtccttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgnttgatctc

SEQ ID NO: 26312 - DNA, 458 bp, Homo sapiens
  misc_feature 36, 409, 415, 439: n = A,T,C or G
aagcgttggaggacattccctgttgactgcgtcgcnatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgngtgggnttacaatacagcaagcctgatggnttgtcttatttcattcata

SEQ ID NO: 26313 - DNA, 288 bp, Homo sapiens
  misc_feature 103, 106, 109, 274: n = A,T,C or G
gaggcattgaggcagccagcgcaggggcttctgctgagggggcaggcggagcttgaggaaaccgcagataagtttttttctctttgaaagatagagattaatncanctncttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagt

SEQ ID NO: 26314 - DNA, 331 bp, Homo sapiens
gatacatgtgatggtatggatgaacctcaaaaacattgtgctaaatgaaacagccagacacataagactgcatattgtatgaaatttctagaaaaggtaaaactaaagacacagaaagtaaatcaatgtttgcctgcagttgggtattggaaccgggattgactgcagatagacattatagaacttttggagtgatgaaagtattctaaaactggattgtgatgaacgttgcacagctaaatacatttgttaaaaaaggttggtacactttaaaataggtgaattgtgtgtaaattatatttcagtaagactgtaaaaaattttgagagat

SEQ ID NO: 26315 - DNA, 346 bp, Homo sapiens
gcttttccggcggtgacgacctacgcacacgagaacatgcctctcgcaaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagctaggcttacagaaggatgttccttcaggaggaagcagcactaaaagcactctgagtcaagatgagtgggaaaccatctcaataaacacattttggat

SEQ ID NO: 26316 - DNA, 316 bp, Homo sapiens
  misc_feature 288: n = A,T,C or G
gacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgcccccaggaaagtggcaggcatggccaaacctaacatgatcatcagtgtgaatggggatgtgatcaccattaaatctgaaagtacctttaaaaatactgagatttccttcatactgggccaggaatttgacgaagnccctgcagatgacagggaaagtcaagag

SEQ ID NO: 26317 - DNA, 427 bp, Homo sapiens
agatggtttttgcaaaagcagaaatcgctgcaaggtaatcacaatagataaaagtggtattttaaacctttaaaataaatggatgtaactgtaccttggtacagcttttcacttgtttagtttttaaacgttagtataatctgaataaataaaatgttgccaaattcaatgtagaaagaatgtgacaacacaccttgggtaggttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccact

SEQ ID NO: 26318 - DNA, 381 bp, Homo sapiens
agaatcatttgaatccggagttgatcagcctgggcaacatagtgagaccttgtctttgttaaataaataaataaataaataaatagtttgggcactgtggctcatatctgtcatcccagcattttgggttgccaatgcaggaggattgcttgagcccaggagtttgagaccagcctgggcagaatagcaagactccatctctgcaaataataaaatattaaccaggtgtggtggtgcgcacctggggtcccagctacctgagaggctaaggtgggaggtttgctcgaggctgcagtgaactgtgaatgcaccactgcattccagcctaggccacagaacaggaccttgtctataaataaagaaataagtaaaaatataaat

SEQ ID NO: 26319 - DNA, 248 bp, Homo sapiens
gtatcctatgcagctacaaatattttttaaatgttagtaataaacattggaattttgtcttaaagagttcaaaaccttggaacccagttttctcactacgtctataaaggccattacagacccaaggctgttttgcagttttcatatgttgtttgctgaagtcattgtaattttttttgcctgctttgcctttttttctacaggagttttgagtgtgaaatgaaaattaaagtttggtacatatattt

SEQ ID NO: 26320 - DNA, 227 bp, Homo sapiens
tctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatctt

SEQ ID NO: 26321 - DNA, 400 bp, Homo sapiens
  misc_feature 2, 11: n = A,T,C or G
cnacctgtgantgtttgttgctgtttttggtaatcctgtgcagtgtttcttgcatttcttgtgatcgtcattccttcattcctaacaaaggaagtgttcatacctcaagatgggaaaaaggtgacgtggtattgctgtgggccaacccgtctatgacgcatctcacatggggcacgccaggtaggtccaccgcggggtgtccctgcagcttctgcagttgcacgcagaagtcagagccattgggatccacagcagcgatcttaggtccacaaagatcttagatctgctacagagacctgagatttgaggaatcaagactgaatttcttctcttatttttaagatggaaaatttttaattccataagtaatctatattcactgcagaaagactacagatca

SEQ ID NO: 26322 - DNA, 212 bp, Homo sapiens
  misc_feature 102: n = A,T,C or G
atttgatgtttgtagaagtgttgcatgaaatccctgctatctttcttcctgcagaacagccaaatttgatatgaatgaccatcaaaatcagaaggctaggcntcggtggctcatacctgtaaacccagccctttggaaagctgaggaaggaggattgctggagcccaggaatttgagattaacctgggcaacatgacaaaactccatctctt

SEQ ID NO: 26323 - DNA, 183 bp, Homo sapiens
  misc_feature 12: n = A,T,C or G
cggaccttttcncagcattgcccacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacag

SEQ ID NO: 26324 - DNA, 455 bp, Homo sapiens
  misc_feature 2, 20, 31, 38, 39, 55, 62, 71: n = A,T,C or G
tntattggcccgggggaagnagctccctatnctggganntgcctgttctccaaanagaggcnaagaatacnaacacctatgcaggtgcatttaatagttttcgtaccagatatggcatttgttacatcttcccatattctgttagccaggttatatgtctaagcctggtgatgaggcaaagaaatgtatttcatctattgggaggcaaaagaagtcacatggcaaagggtgggaaaagataatttggaacataatacaacctaccacatgtgttaggcttctaagacatgttagattccttccctcttcagcacttatcttcccatttcaggattactgagcaagtataaaatatgaatacatcttgggagaggtaaatttagattaaccttaatttcacccagggtagcaattaaatactgttcccagagcaggttccagctgagggttgcaac

SEQ ID NO: 26325 - DNA, 152 bp, Homo sapiens
  misc_feature 8, 41, 109: n = A,T,C or G
gagagaangaaaagccctgaatacctattggtgagggttgncctatttttaacccttacttaaggagcctttgaaagtttttgaacagaggaataaccgtgaataaatnaatgcttggaagacataacccttcagaaacagagtggaatggg

SEQ ID NO: 26326 - DNA, 285 bp, Homo sapiens
  misc_feature 5, 6, 25, 27, 38, 47: n = A,T,C or G
cggcnntttatggcccgggcagtgncnagttagatgcnaatgtttanaagaaattgattgttaaacccaaatttacacctggcatgtgtggtgtagtttctaaaaggcacttcacatttgaaatttttcttaccttagaaagtttctagtgatctaaatgtctagttttgtattcttttgtgtgtgttcacctgtttctcagtattaccacttgaataattctctgtacaggggggtttgtgctatacactgggatgtctaattgcagcaataaagcctttcttt

SEQ ID NO: 26327 - DNA, 160 bp, Homo sapiens
  misc_feature 37: n = A,T,C or G
gatctcatctattcctttacggcagggtacctacggnaccctgaaaacaacgatggcatggaaaacacttcccatttacctgttgttgctgctgtctgttttcgtgattcagcaagtttcatctcaagatttatcaagctgtcagggagatgtggggaag

SEQ ID NO: 26328 - DNA, 415 bp, Homo sapiens
  misc_feature 5, 7, 370, 394: n = A,T,C or G
tgtantncttctttgtaaactttgtgcctttttttaatcagctattccctcgaaggtgtacatggttgtatgtaatgaacaattgcttgctatcaatatctggtaagtatattagtttttaaataccttacaattgttactatttattatttagcttttatgtcatatctgtttttctttataggtaaagcttctcagctttattcccataatttaccagggctttttgattatgcaagacaaatgcaaaagttacctgttgctattccagcacacaaactccctgacagaatactgccaaggtaagggtacatccttagaggcaatatgatatttaacagttcattctcataatattttatgttacagnaaaggggaaagagcactcagtttngggttaataaaaatcatgagg

SEQ ID NO: 26329 - DNA, 280 bp, Homo sapiens
  misc_feature 6, 32, 93, 170: n = A,T,C or G
atggcncgggaaggatggcagatttctttccntttctggagaatgatgattggaaacctcattgaaaaccaatgacacccattttagaaagcnccccagcccagttgatgaattagaaggcagatactttcaggttgaggttgagaaaagaatggtccccagtgcagcancttctcagaatcctgagtcagagaaaagaaacacctgtgtgttgagagaacaaatcgtggctcagtaccccagtttgaaaagagaatgtgaaaaaatcattgaaaacttc

SEQ ID NO: 26330 - DNA, 267 bp, Homo sapiens
  misc_feature 5, 6, 155, 161: n = A,T,C or G
cgaannttggaagtggaggctggttgggcacctgcctgcccccatgtccctgctggtttggtcattaggatggagcctgagcctgtctttgggaagtcagtaggttgctgtgagcctgctggaaaatgaggcaagattccggaagggtgctgtgnctcatncctgtaatcccagcactttgggaggctgaggcagtaggattgcttgaggccaggagtttaaaaccagcgtgggcaacatagcaagaccctgtctctacaaaaatac

SEQ ID NO: 26331 - DNA, 473 bp, Homo sapiens
gagtggacaagagtgggtgtagttacttaccatcgtttcttcttctggagggtcttcaagagggaaggattagcatgtcgtccataatcagaaaggtgatcagcaccacaaaagccccggcggccattggtccctacagtcaagctgtgcaagtggacaggaccatttacatttctggacaggtaggcctggatccttccagtggacagcttgtgccaggaggagtagtagaagaagctaaacaggctcttaaaaacttgggtgagattctgaaagctgcaggctgtgacttcaataatgtggtgaaaacaactgttttactggctgacatgaatgactttggcactgtcaatgagatctataaaacatatttccagggtagcccttcctgccagggctgcttaccaagtcgctgctttacccagaggaagtcgagttgaaatcgaagcaatcgctgtccaggggcctttcat

SEQ ID NO: 26332 - DNA, 158 bp, Homo sapiens
  misc_feature 4, 25, 38: n = A,T,C or G
gctnaaattggcatatgctgtaagnaataaaatgttgnattgattgtatggacacctcttgaggacggtgtctgccatatcaagtacctatccattatatcaggtaatatcgtcattatgaggacccagaggagaaatttctctctgatcttactccc

SEQ ID NO: 26333 - DNA, 472 bp, Homo sapiens
  misc_feature 22: n = A,T,C or G
ataaaaagaaatactctatttnttagtaatcagggaaatgcaaatcaaaagtgcaatgaggtacattcagctggtaaattttcagaagtctgaaaagcctataccggtgagaatgtggatcaacaagatttcttatgcattgctggcaagagtataaattgctagaagcactttgaaaacaatgtggcactctgcctgttgagcaatctgcccactgttgctcatttacgtcaactgtgttccagcaattgcacttctgggtataaacctaagaaaaacttcacgtctgcaccaggagatgggaaagaatatacacagcaacattttttgtaaaagcaaaaagtctaggctgggccgtagactcatgcctgtaatcccagcactttgggaggctgaggcaggcggatcacgaagtcaggagttcgagaccagcctggccaacatagtgaaaccccatctctactaaaaatac

SEQ ID NO: 26334 - DNA, 396 bp, Homo sapiens
  misc_feature 2, 9, 41, 46: n = A,T,C or G
tntatggcncgggatgaaattgaaatgttttagatgtttcnttccntagattggtaatgaggatttgggataatatcattagaggattatctcagtatcattaagaagtgtcaacttgcatatgagctattttgaaggagatgagtgaataagttatttggttctaactagaaggaacccataaaattatgagaataatgtccatatacaaggtaaccctgaatataatgcattctgtcatctttgcagtgaaaaaatatttttaaaaagtgatgtgaggccaggcatggtggctcgctcctgtaattccagcactttggaagaccaaggtgggcagatcacttgagctcaggagttcgagaccagcctggccaacacagtgaaacccagtctata

SEQ ID NO: 26335 - DNA, 497 bp, Homo sapiens
  misc_feature 1, 26: n = A,T,C or G
ntggcccgggaagtttaaaactaganaatctgtttccccatggataccagcttcagctcataactctatatggatagatagtgtaacattagtctcctgacacaacatagaggtgaaaaataaaagtaaaaggagtgtttgtctttaagattgcactgaatttcctaaatgtgaaaatttgagcaagtcctaaaaattaataaaagctttacatagctaactaaaaatatcatttcctatctccaaaattaatctcatatataacagaggtttccctacatgtttgtggttctagtatgtttaatcatgggctggagaatgacttggttaagatttgcttcaattccttttatgaaaaaaactgtggctaccttggcatttcattgccctacataagtgttcaacaaatgtgctgaatttattttttaaaagctgatacaaacttcttgattgtcctgtaattctctttccctgtcagtgctgcctgtgtctcccta

SEQ ID NO: 26336 - DNA, 134 bp, Homo sapiens
  misc_feature 4, 67, 72, 91: n = A,T,C or G
cttntagacacaggcggtcatagaagcagcatcgagacggcggccacattctaagtctaggagtcgncgacnatccaaaagcccaaggcgnagaagatctcattccagagaaagaggtataaggtcaaggcagc

SEQ ID NO: 26337 - DNA, 469 bp, Homo sapiens
  misc_feature 146: n = A,T,C or G
aaggaggaagcttatctatgaaaagcaaagcactatcacaaggaatataggcagatgtacagaactgaaattcgaatggcgaggatggcaagaaaagctggcaacttctatgtacctgcagaacccaaattggcgtttgtcatcangaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttc

SEQ ID NO: 26338 - DNA, 470 bp, Homo sapiens
  misc_feature 36, 49, 259, 272, 431: n = A,T,C or G
gatgggtagggagaataaatatcatgaaaatggccncactgcccaaggnaatttatagattcaatgccattcccatcaagctaccaatgtcttcttcacagaattggaaaaaactactttaaagttcatatggaaccagaaaaagagcccacattgccaaggcagctcctaagcaaaggaacaaaactggaggcatcatagctacctgacttcaaactatcctacaaggctacagtaaccaaaacagcatggtactggnactaaaacagatntatagaccaatgaatcagaacagaggcctcagaaataacaccacacatttacaaccatctgatctttgacaaacctgacaaaaacaagaaatggggaaaggattccctgtttaataaatggtgctgggggaaaaacctggctagccatatgtagaaagnttgaaactggatcccttccttacaccttatacaaaaatt

SEQ ID NO: 26339 - DNA, 472 bp, Homo sapiens
  misc_feature 5, 460: n = A,T,C or G
gttcnaacagatgatgctttgcaagaacttgtagaactcatctatcaacaggccacatctatcccaaatttctcttatatgggagctcgcctgtgtaattaccctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattggtaaaaggttgacaggatcagtttttggaagatgcttggaaggaaaaaggaaagatggatttnggaagaaattat

SEQ ID NO: 26340 - DNA, 345 bp, Homo sapiens
  misc_feature 15: n = A,T,C or G
gaaaccaatgagaanaagacacaacgtaccagaatctctgggacacagctaaagcagtgtttagagggaaatttatagcaccaaatgcccacaaaagaaggtgggaaagatttaaaattgacaccctaacatcacagttaaaagaactagagaagcaagagcaaacaaattcaaaaactagcagcagacaagaaataactaagatcagagcagaactgaaggagatagagacacagaaacacttcaaaaaattaatgaatacgggagccaggtttttgaaaagatcaacaaaactgatagactgctagcaaaactaataagaaaagagagaataatcaaatagac

SEQ ID NO: 26341 - DNA, 122 bp, Homo sapiens
  misc_feature 2, 4, 31, 117: n = A,T,C or G
antntcggccctttattggcccggggaggcnttgaggcagcccagcgcaggggcttcttgctgagggggcaggcggagcttgaggaaacccgcagataagtttttttctctttgaangatag

SEQ ID NO: 26342 - DNA, 470 bp, Homo sapiens
catgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatggggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtctt

SEQ ID NO: 26343 - DNA, 364 bp, Homo sapiens
gccaaatttccgtttaagtaattgcctacaataaaaagaaattttgcctgcattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttg

SEQ ID NO: 26344 - DNA, 461 bp, Homo sapiens
aaactcggtggtggccactgcgcagaaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgctttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgccttttcccatctgtctatctatctggctggcagggaaggaaagaacttgcatgttggtgaaggaagaagtggggtggaaga

SEQ ID NO: 26345 - DNA, 307 bp, Homo sapiens
  misc_feature 306: n = A,T,C or G
gagatcaacctgtgcaacacagtgagacccaatctctacaaaataacttttaaaattagctgggcatggtggcacacacttatagtcacaattacttgggaggctgaagcagggtgatcatttgagcccaggagttcgaggcagcagtaagccatgatcactccactgcgctccagcttgggcaacagagcaagaccctgtctgtaaaacaaaacaaaacaaaacaaaaaacaataagcaatggaggaaatgtttaggcaataatcatggcgaatacaaagacattaagaaaatgaagaggagatng

SEQ ID NO: 26346 - DNA, 334 bp, Homo sapiens
  misc_feature 16: n = A,T,C or G
gatatactcataagcnaaatactgtacagtcattaaaaatggctggaacaggctgggggcattggctcatgcctgtaatcccagcactttgggagggcgagaaaggtggatcacctgcggtaaggagttcgagactatcctggctgacatggtgaaaccccatctctattaaaaatacaaaaaaattagcagggcatggtggtgcatgcctgtaatcccagctacttgggaggctggggcaggcaaattgcttgaacccgggaggtggaggttgcagtgagccgagatcgtaccactgcactctagcctgggcaacagagcaagactctgtctc

SEQ ID NO: 26347 - DNA, 474 bp, Homo sapiens
gtgataacttggagcagtactttatacaacaaggaggaggtaattttttctcacttgaaataaattgtgtttatatcctcttgtaatagattattaatctcatgttgatgcaatctagaatacatgcacagaatttaaagcagttgatggcatattttaagtatctatgcttattcagtacttttccatatgataagccctaggaaaaacaagagagaattttccacgtaggtacattttcattacagtaaacttgaatcacagcatcctaagagttttatattatatggaagaaggataaagtaatttattagtcttaaaatttaaaatatgatcactgaaataatagaatgtatgtccttttaaacccagtagatggggaaaggggaatgaggaaaaaaaacctaaacaacagcaagaaaggaaggggaataaaatgagaaaaattatggttagaaattatagaataagatc

SEQ ID NO: 26348 - DNA, 474 bp, Homo sapiens
  misc_feature 411, 421, 448, 457: n = A,T,C or G
gaagaacagaaaaccaaacattgcatgttctcactcacaagtgggagttggacaatgagaacacatggacacagagaggggaacatcacacactggggcctgtcggtgggtgggagtctaggggagggatagcattaggagaaatacctaatatagatgacgggttgatgggtgccgcaaaccactatggcacatgtgtacctaagtaacaaacctgcatgttctgcacatatatcccagaacttgaagtatatctatctatctatctatctatctatctatctatacacacacacacacacacacacatatatatatatacacacacatatatatatatgtatatacacacacacatatatatatatagagagagaggtcttttgaaataacccagtgagacaaaaacanacacacacanatattgaaagcctatggggtttatggnacaccatcnagtgaacaaatgttatg

SEQ ID NO: 26349 - DNA, 474 bp, Homo sapiens
  misc_feature 259, 374, 453, 455: n = A,T,C or G
atattacttttattagttggtttaaaaaaataaataattttaaaaatattttaaaaagaggaaaataagaactcctatttcacactggaaagccaaagaccatgactgttaaccattttgataacttttctcaggtcatcctctttcctttcctgccttccctcttttatttcatccacttatttttttttctttgtgcaatattgggatgatattatgtacgtggtttagtaccctgatttttttcccccagtaatgngttttattttctgtatcacaacaaatgcttttctgtgacatctgggcaatttgcctctatgcatagggtttcgaagacttcaggtggagttggctgggggcttcctaagtagagngggaatgtcaactggcctggggaccatttagaaataattctgcccattacaaatattggatttgatgcaggcttaagangntttctaattttaaaaatat

SEQ ID NO: 26350 - DNA, 383 bp, Homo sapiens
  misc_feature 5, 59, 141, 152, 209, 221, 223, 341, 371: n = A,T,C or G
ctganatgggcagatagcttgagctcctgagttcaagacccacctgggcaacatagcanaaccctgcctctactaaaaatacaaaaattatgcctggcgtgggggcgtgcatctgtagtcccagctactcaagaggctganctgggaggatngcttgagcttgggaggtcaaggctgcagtgagctgtgattgcaccactgcactccancctgggtgacanancaagaccttgtctcaagacaaaaacaaaaacagacaacccaccaattggtaataggatactgctggttgttaggctgcaatttgagtagcaagagtctagagctgcactgttcaatanaactttctgcaatgataaaaatgctcttangtgttttctaat

SEQ ID NO: 26351 - DNA, 373 bp, Homo sapiens
gtaaatggtattaggcccatatttcctgaaccgccttcagaatataaggtctgacaaatatttctatatttatggggatggtggaattgaatatttcaattatgctgtctcagaaattcctgagtctagggaacttctggcaatcattttgttccagttgtcatcaggagcatggagctcagagacctgccggagaggttatggggtgagttgggcctggcaaatgcaccccatattgagtggctgagaagcctctagaaatggaaagtttattgtaagaggaatgttctctgcgcttccttcctcctttgccatctccttcaactgctccccgctcactcccagtagaatctggagctgatctatctctacg

SEQ ID NO: 26352 - DNA, 334 bp, Homo sapiens
gctggatggtgaatttcagtcagcctcagtagttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggag

SEQ ID NO: 26353 - DNA, 381 bp, Homo sapiens
ggaatcagatcagacctctgatccttagtttcggccggtgtgtaatggtgattgcagtgtccgtctcatttactcaaccctttcccaagttgttggaggactaaatgaggtaatgctaataatgtatctagaagaatgccagacaaataagcttttattattattattcctgtttacagataaataaattgaggctcagggaggttaagtgatttgtccaatagacataacttgtaacttgaggacccaggacttgtttacaagtaatattttaaaacttgtcaagaatccatacagcagatcaactgagtacagggctgaattatgacttgttgggccatgggcatttttgccttcatgggccccttccaccatagggag

SEQ ID NO: 26354 - DNA, 414 bp, Homo sapiens
atcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataatttt

SEQ ID NO: 26355 - DNA, 472 bp, Homo sapiens
aggataggtgctttggcaatggtgatgggaatccaatatgaaaagaaaaggaggtacaagtcaaaggaggagaaagaaaggaacagagcaagcattttggagtggcctgcctgatctgttcatgaccaccatcctggtaattgtttctgctctgagccactgaacttattctttgtataaattatgaattactattaagcttaatgaagaaatgtttaactgttgggaatatacttttagtaatattaacatgaaaaggagaattggacattttcaatcaaattttcatttctctgagtgtttttgctttactctgattttttagtctggcatttaatcacatgagcggtttaccttagaatatattgctaattcatcttactactcgtaaatggagttgggaggctgttggctgagttgtcatctcatgtgtctttgaatttaattttaattttacatttcaatgttgtga

SEQ ID NO: 26356 - DNA, 131 bp, Homo sapiens
  misc_feature 4, 9, 13, 40: n = A,T,C or G
actncactnaagnctgttaatggacaaatagcaaagcctnattagtcctgatggttctcgtaaaaaccccgctagaaactgctgagacctgaaattctgccatcctgaactcaagagtggagaatactggg

SEQ ID NO: 26357 - DNA, 473 bp, Homo sapiens
gacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgaagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctaaatcattctcatttacttaattgaggagtaaggagactaaaaagaatgttcactctttcaattt

SEQ ID NO: 26358 - DNA, 474 bp, Homo sapiens
  misc_feature 13: n = A,T,C or G
atgtctctctgcnaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatcttt

SEQ ID NO: 26359 - DNA, 471 bp, Homo sapiens
  misc_feature 27, 56, 62, 73, 78, 267: n = A,T,C or G
agcctaaccatttacccaaataaagtntaggcgatagaaattgaaacctggcgcantagatntagtaccgcanggganagatgaaaaattataaccaagcataatatagcaaggactaacccctataccttctgcataatgaattaactagaaataactttgcaaggagagccaaagcttagacccccgaaaccagacgagctacctaagaacagctaaaagagcacacccgtctatgtagcaaaatagtgggaagatttataggtngaggcgacaaacctaccgagcctggtgatagcttggttgtccaagatagaatcttagttcaactttaaatttgcccacagaaccctctaaatccccttgtaaatttaactgttagtccaaaggaggaacagctctttggacactaggaaaaaaccttgttgagagagtaaaaaatttaacacccatagtaggcctaaaagcagc

SEQ ID NO: 26360 - DNA, 389 bp, Homo sapiens
  misc_feature 6, 14, 48, 55, 58, 65, 73: n = A,T,C or G
tatttnaggaatcnaactatggcacgtaaagctgggctcaccggatgncctattngcnctatagngagacgtntagggggttcttcgctcaacctcttctcccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccactttaactgactagctttgataaacaatgtcaggattttaactatgaaaacgacattaccttgt

SEQ ID NO: 26361 - DNA, 291 bp, Homo sapiens
acaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattca

SEQ ID NO: 26362 - DNA, 497 bp, Homo sapiens
  misc_feature 4, 7, 50, 51, 143, 274, 337, 432: n = A,T,C or G
aacncgnttttatggccggcatacacaaaattccttttcccgagaaaagnngctttctcaataagcctcagctttctaagatctaacaagatagccaccgagatccttatcgaaactcattttaggcaaatatgagttttatngtccgtttacttgtttcaggagtttgtattgtgattatcaattaccacaccatctcccatgaagaaagggaacggtgaagtactaagcgctagaggaagcagccaagtcggttagtggaagcatgattggngcccagttagcctctgcaggatgtggaaacctccttccaggggaggttcagtgaattgtgtanggagaggttgtcttgtggccagaatttaaacctatactcactttcccaaattgaatcaccactcacactgctgatgatttagagtgctgtccggnggagatcccacccgaacgtcttatctaatcatgaaactccctagttccttcatgtaccttccctg

SEQ ID NO: 26363 - DNA, 366 bp, Homo sapiens
  misc_feature 295: n = A,T,C or G
tatggcgggggttttgaaatgatatgaccaaaattttaagtaggaaagtaacccaaacacttctgctttcacttaagtgtctggcccgaatactgtaggaacaagcatgatcttgttgctgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtatagttatggngggtgattattttttatactgtatgtgccaaagctttactactgtggaaagacaactgttttaataaaaga

SEQ ID NO: 26364 - DNA, 498 bp, Homo sapiens
  misc_feature 3, 17, 81, 238: n = A,T,C or G
ccngggtaactcggttnttatggcgggggaaggaaggtggcagcattcagcagtatatttataaacaggaacctgtacagnaagtgccctggaagaaaggcctgctctaaattatccagtgtatggagaaacgacacaggttaggagacgtcgctttgaacgtgctataggaccttctcaaacacacaccatcagaattcaatattcacctgccagactggcttatcaagacaaaggngtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatg

SEQ ID NO: 26365 - DNA, 176 bp, Homo sapiens
  misc_feature 19: n = A,T,C or G
gtattgcctttgtatgttnagcaaaaattatttttagaaatttaagcctgggcaacatagtgagacccagtctgtacaaaatatgaattaaaaaaaacttaaaaaatcagcaggcatgatggcgcacgcctgtagtcccagccacttggcaggctgaagtgggagggttgctcgag

SEQ ID NO: 26366 - DNA, 314 bp, Homo sapiens
  misc_feature 14, 16, 72, 187, 188: n = A,T,C or G
gccctatagatggntnggctatataacattgccacttcaactctaaggaatatttttgagatatccctttgnaagaccttgcttggaagagcctggacactaacaattctacaccaaattgtctcttcaaatacgtatggactggataactctgagaaacacatctagtataactgaataagcaganntcaaattaaacagacagaaaccgaaagctctatataaatgctcagagttctttatgtatttcttattggcattcaacatacgtaaaatcagaaaacagggaaattttcattaaaaatattggtttg

SEQ ID NO: 26367 - DNA, 462 bp, Homo sapiens
accatagagacccagctgagtatgacttgaggaaacctttagagaaataaagaagaaaaataaggtgtgatctggatacatctgcaaagacaaatgaaggcactgttcggggctttaagtagagccacagaaagaagacaatgaggacactgcaagttgggcatgaaggaagctgccaaatattaggaattataaaactgggatttcagaatcagttctgctatgagtacatcttttctattttcagggattcagtttacttttcagtaaaaagaaaaataaaatatgcctgggttgggggagctcaaacacttccaaattccctttcaattgtaacattttggaagtctgagagagtagggtattggcttaaggacacatgtcccacaagaagtatccagggtgagaatgggagtacaggacctatcatgcattcagtatctattctgagctaggggctat

SEQ ID NO: 26368 - DNA, 156 bp, Homo sapiens
  misc_feature 12, 28, 29, 32, 38, 39, 49, 139: n = A,T,C or G
aatgccggctgngttcaaaaccgtggtnnctntggagnnttacaggagnatttctgaaagagaactgccgtcctgatggaagagaacttggtgaattcatgaaccacaactgtcaacatcggttcaattagtaccgcanatggttctgctttagtg

SEQ ID NO: 26369 - DNA, 100 bp, Homo sapiens
  misc_feature 13, 22, 29, 36, 37, 56, 65, 78, 87, 89, 94: n = A,T,C or G
ccctgtgaagggnatctttgancttatanctgagtnngcttccagaattctgtaanttcctagcntgacaaacagganggcctttgntncattnggggct

SEQ ID NO: 26370 - DNA, 199 bp, Homo sapiens
  misc_feature 2, 11, 45, 169: n = A,T,C or G
anaaaagacangtctaggaaacaaaaagctaagggcaataatgtncaaacttagaagaaaattggaagatagaaacaagatagaaaatgaaaatattgtcaagagtttcagatagaaaatgaaaaacaagctaagacaagtattggagaagtatagaagatagaaaatntaaagccaaaaattggataaaatagcactg

SEQ ID NO: 26371 - DNA, 242 bp, Homo sapiens
  misc_feature 3: n = A,T,C or G
agnctgaggcagaaggatcacttgagctcaggggttcaagaccagcttggccaacatggtgaaatcctgtctctactaaaaatacaaaaattagccaggcatggtggcaggcgcctgtaaacccagctactctggaggctgaggcgggagaatcgcttgaccctgggaggcagaggttgcaatgagccaagatcgtgcctttatactccagcctgggcaacagaggaagacaccatcttggg

SEQ ID NO: 26372 - DNA, 353 bp, Homo sapiens
gagactggtaatataataaaatgttgaaggagtggccatggtcttagcaggttttagaatgaccttttaactccagtaactacttccttggtattggtatccttgatagggggaatataacatctggcagtaatctcattcaggttatactacctgactaaatttaatcatactttcatgtatttgtttcctcagttggacctaagttactgtatttgtttttcttatttttttattattgtacagtttctttacctttcaagtataaatgtgtatataaaatgtaaatacaaagaattcactaaaaaccactcataacaattactgtgtaaataaaactggtaagcagagta

SEQ ID NO: 26373 - DNA, 398 bp, Homo sapiens
  misc_feature 29, 395, 396, 397: n = A,T,C or G
gggaaggatagcattaggagatatacctnatgtaaatgacgagttaatgggtgcagcacaccaacatggcacatgtatacatatgtaacaaacctgcatgttgtgtacatgtaccctagagcttaaagtataataataaaaaagagacctgggatcataaaggtcctaaacatcattgaatcccgggtcatggagcccaggaaccatatagcaaatgaattctagagctctaaaaacagggagcttgaaccttttagatgaccagtgtccaatatgactttcgtgatgatggaaatgatctaaaattctgtgctatctaatatagtagccactggcaacatgtggctattgaacacttgaaatgtggctactgcaaataaagaattaaatgtttnnnc

SEQ ID NO: 26374 - DNA, 408 bp, Homo sapiens
  misc_feature 391: n = A,T,C or G
aatcagcatacagattggatgcccactgggtgctggtctttgttacggacgtctctgctttgtctaggagggctgttctgccacctggccaaagcagccactcctgttgctggaggctgcaggcccattgcactgagttgtcctcgaggcaaaatctctctggttctggcagaaacaactctggtgactttctttgtgattgtagacttaaagcaaacacacgctccctgttctcagggaggccctgtgtcttcttagacacacagagatttttaaaaaataacagctttggccgggcatggtggctcactcctgtaatctcagcatttggggaggccacggcaggcagattgcttgagctcaggagttcaaggcgtctgggtaacctggngaaactccgtttctact

SEQ ID NO: 26375 - DNA, 465 bp, Homo sapiens
gtttacttcgtttattattttacagtaaatttgaataaatcttaggggtcattatcacttaaataatactgtacctaggtctttcaaattaaaattatacctgaatgaagctgtttgtatacataaaggatatttgtgtacaatttaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccct

SEQ ID NO: 26376 - DNA, 415 bp, Homo sapiens
  misc_feature 7, 30, 32: n = A,T,C or G
gagcatntaagaaaaagggccaaaagcctntntgaaactgatggtacttgttttcaccattgggctaactttgctgctaggagttcaagccatgcctgcaaatcgcctctcttgctacagaaagatactaaaagatcacaactgtcacaaccttccggaaggagtagcttgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatat

SEQ ID NO: 26377 - DNA, 152 bp, Homo sapiens
ataaacctaattgttattgttcaagaagctagaaataaataggacagtttttgaaagacaatttttggaggaatcagatttttaaaaatcacaggaacaggaacttgcatgaacatgaagggaatctgatttttgctttgatctgatcttgc

SEQ ID NO: 26378 - DNA, 485 bp, Homo sapiens
  misc_feature 31: n = A,T,C or G
atagacaaattgcttcactacattttaaaanttgattgtaaaatatttagccagaaatttcgtatgctccaatggcaacatttttctgtgacttttctgtttctctgccattgtcctcttttttccctcaattcttttttaattgatctgtcagtggtgtgcatatgatcgcttttttgccgctcatatttgaatgcattgggtttcctggaccagctatttgcacaagactagggggaggttgagggttggcatagcaggcaggggctgggatagacattcaacctagcttgttttcatgctcttaaggctttatttttctagaatgccaagaaaccaactttctttaaacatgactcatctcttcgattttcttgtataggtcttcctcccaccccaaatctacacttgttagaaacagaataattacctttgcttactccattatcaacacttggagatagagactttacacttcagattgt

SEQ ID NO: 26379 - DNA, 100 bp, Homo sapiens
  misc_feature 3, 4, 6, 8, 10, 34, 49, 63, 68, 74, 79, 84: n = A,T,C or G
cgnngnangnaaacaaagcccactgaccaataancattgcacattcgcnaaagtctcttcatnggtangaaagnagccncgtgncgcatgaccttacttg

SEQ ID NO: 26380 - DNA, 341 bp, Homo sapiens
  misc_feature 266: n = A,T,C or G
gctgcgggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtntttaaaagaaaagaatagagaagatagggaaattagaagataaaaacatacttttagaagaaaaaagataaattt

SEQ ID NO: 26381 - DNA, 192 bp, Homo sapiens
  misc_feature 24: n = A,T,C or G
cattatttttgctacactacattncatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttt

SEQ ID NO: 26382 - DNA, 254 bp, Homo sapiens
  misc_feature 3, 4, 239, 244, 249: n = A,T,C or G
ganngatatagttctctaaacttccgtagcatcatttgattgacctctattcagattcaagtcaactaccaattatcagagccagctgagtctgctctatccatgcctaatggcctgttctatccatctgtaaaatgagacctgctgcggcatattcaggtgttctttacgcgaacacattagccttctaatttatcatgagaatcacattttaagaataatagggagtgtgtgcagcnggatnatgtngggac

SEQ ID NO: 26383 - DNA, 283 bp, Homo sapiens
  misc_feature 14: n = A,T,C or G
cataagcacatagnaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtg

SEQ ID NO: 26384 - DNA, 500 bp, Homo sapiens
  misc_feature 11, 16, 41, 55, 73, 80, 98, 106, 239: n = A,T,C or G
tatggccgagnagatnagagttcttctttctttcttaagcnctttgctctggagnaagttctccagcttcagntgaactnacagcttctgcaagcatnaccctggnagtttcctgagggttttctcataaatgagggctgcacattgcctgttctgcttcgaagtattcaataccactcagtattttaaatgaagtgattctaaagatttggtttgggatcaataggaaagcatatgcngccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaac

SEQ ID NO: 26385 - DNA, 486 bp, Homo sapiens
  misc_feature 2, 247: n = A,T,C or G
gnttgcggttggtgtgcgggtttcggttgttggactcgttggggaggtggcctgcccttgtagagactgcatccccgagacgatggcggagggagataatcgcagcaccaacctgctggctgcagagactgcaagtcttggaagaacagctgcaaggatggggagaagtgatgctgatggctgataaagtcctccgatgggaaagagcctggtttccacctgccatcatgggtgtggtttctttggngtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaaccta

SEQ ID NO: 26386 - DNA, 424 bp, Homo sapiens
  misc_feature 17: n = A,T,C or G
cagaaaaataaaaccgnaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgaga

SEQ ID NO: 26387 - DNA, 246 bp, Homo sapiens
  misc_feature 4, 32, 38, 165, 167, 175, 213, 225, 230: n = A,T,C or G
gagnagcaagagtcaagggcacgagcatcggncttgcntttcttggacatccagaaaaggttcggccttaacatagatcgatggttgacaatccagagtggtgaacagccctacaagatggctggtcgatgccatgcttttgaaaaagaatggatagaatgtgcncntggaatcngggtatactcgggcagagaaagagtgcaagatagaatntgatgatttcgnagagngtttgcctttcggcag

SEQ ID NO: 26388 - DNA, 303 bp, Homo sapiens
  misc_feature 8, 31, 80, 183, 276, 300: n = A,T,C or G
taacctgnaactctccgcctcccgggttctngcaattctcctgcctcagcctcctgagcagctgggactacaggcgcctncaatcatgcctggctaatttttgtatttttagtagagacggggtttcaacatattggccaggctggtctcaaactcctaaccttgcgattcgcccgccttggnctcccaaagtgctgggattccaggcgtgagccaccgcgccccggccagaatggctttatatttaaatagttcataaagaagcacaaaagaatnttttttcataacatgtaaaaattntat

SEQ ID NO: 26389 - DNA, 470 bp, Homo sapiens
  misc_feature 19: n = A,T,C or G
atgattgaacacgcacagnaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttccgaaaagacaatttagcaggtagaagaaaagttgggctttcacaaaaggcatctgaacttttaatgaactgtgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttag

SEQ ID NO: 26390 - DNA, 470 bp, Homo sapiens
actcaagcaaacgtacaaccacagtgctttcttcaaatcatatgagaaatactatgcctagcaaggagatgcagagccgccaggaaaattctgagttccagcacaattttctttggaatctaacaggaatctagcctgaggaagaagggaagtctccatttctatgtctggtatttgggggttttgtttgtttttgctttagcttggtgaaaaaaagttcactgaacaccaagaccagaatggatttttttaaaaaaatagatgttccttttgtgaagcaccttgattccttgattttgattttttgcaaagttagacaatggcacaaagtcaaaatgaaatcaatgtttagttcacaagtagatgtaatttactaaagaatgatacacccatatgctatatacagcttaactcacagaactgtaaaagaaaattataaaataattcaacatgtccatctttttagtgat

SEQ ID NO: 26391 - DNA, 170 bp, Homo sapiens
gttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaac

SEQ ID NO: 26392 - DNA, 476 bp, Homo sapiens
  misc_feature 178, 225, 289: n = A,T,C or G
agtttgaggtgtgttccatggctctgccttgttgtgttttcattttttaattactcaacagtttgctacaacgactgagatctctaccatagaaattgcttcttggattgagatattctttccagaatgtcacagaaaaagttttatattttacctgggttgatttaacttcatcggngggaagacctgattcttctttttatagagatgtatataactcattgngattagttccttttatccttgctaccaggaaaacaatggtaaattggaatatataaaaactatntagattataatcaataagtttatatacatgtgtataactgtcccacttttgctatatgagcccgctcatggcttcatcattttttttaacctagaacttttcttcaactcctaaggacctgcacaactttgagaatggagccattttagagacctataaatattaattctaatacactatcactagg

SEQ ID NO: 26393 - DNA, 387 bp, Homo sapiens
  misc_feature 6, 381: n = A,T,C or G
gagtgnccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactggcggcaataaggatggctggagagatgctgctctgaaacacaaggtccnacggga

SEQ ID NO: 26394 - DNA, 189 bp, Homo sapiens
  misc_feature 187, 188: n = A,T,C or G
gaattattagaagactcgtttctttccctagtagacataactgagccagtgaatctagttttggctattctgtattttgtccagtttttcccataagaaagcaatatttttttatctcagtttcagcaacttccaaaaaatgtgattatgggacctactttatattaaattatggggtcagggacgnng

SEQ ID NO: 26395 - DNA, 108 bp, Homo sapiens
  misc_feature 54: n = A,T,C or G
ctaccggggaaagctgaggcaggagaattgcttcaatctggaaggcagaggttnagtgagattgcaccattgcattccagcctgggcaacaagagggaaactccgtcg

SEQ ID NO: 26396 - DNA, 455 bp, Homo sapiens
gaaggggctaggccggcttgaaagaatttatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgc

SEQ ID NO: 26397 - DNA, 252 bp, Homo sapiens
gaagcgttggggcggcaaaaatttttgttgatggtatggagagataatgggcgatgtttctcagggctgcttcgagagagattaggggtggcatgggaacctagagtgggagagattaaactgaaggaagattttggggtaaggggtgatattatggggttgttagaaggagcatttgtcatatagaatgattggtgatggcctggatgccggttttgtatgaattgagaaactaaacggaagacacaaggt

SEQ ID NO: 26398 - DNA, 373 bp, Homo sapiens
  misc_feature 24, 227: n = A,T,C or G
agatgcgcctggagaaggacaggntctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatgggggnccctcactgtgaatgggaccaagggaaacaggtctctggccctgagcgcaccatttcccatcacccgtgaagagaagcctgctgtcaccgcagccccccaagaaaaagatgcccttttcttggaattgcattttttaaaacaagga

SEQ ID NO: 26399 - DNA, 305 bp, Homo sapiens
  misc_feature 151: n = A,T,C or G
aaagatgttctttgaaaccaatgagaacaaagacacaacataccggaatctctgggacacattcaaagcagtgtatagagggaaatttatagcactaaatgcccacaagagaaagcaggaaagatccaaaattgacaccctaacatcacanttaaaagaactggaaaagcaagagcaaacacattcaaaagctagcagaaggcaagaaataactaaaatcagagcagaactgaaggaaatagagacagaaaaaacccttcaaaaaaaattaatgaatccaggagcatgttttttgaaagaccaac

SEQ ID NO: 26400 - DNA, 168 bp, Homo sapiens
  misc_feature 123, 126: n = A,T,C or G
gatactgtttcttgcactgaatatataaacactccacagtgtttatattgggaagatattgggaaggaaatatatttgtaaaagatgaaggctgtatctattttttttttctttttaaagttngtncacttaaattcttttgaggatgggatgtatttttcttgctgc

SEQ ID NO: 26401 - DNA, 112 bp, Homo sapiens
  misc_feature 28, 30: n = A,T,C or G
gttcctgggtttcagattcaaatttcantnagctctcagtgatagagatgtgctttcagtacatttaagggaaaaaaaaaaccttaaattcttccaaaggagataattatct

SEQ ID NO: 26402 - DNA, 497 bp, Homo sapiens
gcagtgattttattgcagcctgactttggttcccaggaatgctgaagcacaggtcctagaacagaggcttgaaaaggaaataaaagggatttgatcataaatgcttctggggttggcataccagaatcattttgagctcaaataggagacaaaagaaaggatgttgggaaagctgtatggtggagaggctgaactgttggaatgaaaagacaagaagcatgttattatgttaattccagcaccctagatctgcaatgctgaaaggactgccaaaactaaagcttgtcctacaccacgttcatcacaaagaaattctgtttagacgttgagttaaactttctcaactgtattcagtacaggattaagtggttgagatgggccattctgcagttacactgtttccgttccagtctgggtctcctcatgtattagctgtgtggaccttggcaggtaactcctttgtgcctcaaagaaatggagatgacgataatacctac

SEQ ID NO: 26403 - DNA, 490 bp, Homo sapiens
agctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggggatg

SEQ ID NO: 26404 - DNA, 489 bp, Homo sapiens
  misc_feature 6, 29: n = A,T,C or G
aatacnggtgttagctgagaactctgtanttccctttaaaaattatgtatcttttggttcaagattaagaagcataatgacaacaaaaaaagcaggcagaatttatgaataagtgttgtttattattaaaacaataatttgttaatttcttataaggccctgtgctataattactggtataaatataactgaatattggggtagctttcatttcttccattaattacatgtgtaaaattaaaacactactgtaatgttaatttcctggttttgaaaatcatattatggttatgtacattgttaacattaaggaaagctggcagaagggtgtgcataaattctatactctttttgaaacttttctataattctaaaattattttttaaagttaaacagtatattaagattaccttcactattcctcactcaagattaagacattttttgaaaagcagtagagtttgcttaaaatacaaattaattattct

SEQ ID NO: 26405 - DNA, 414 bp, Homo sapiens
  misc_feature 8, 14, 57, 61, 66: n = A,T,C or G
caagcccntgaggnttccggggaccacaatgaacaacttgctgtgctgcgcgctcgngttnctggncatctccattaagtggaccacccaggaaacgtttcctccaaagtaccttcattatgacgaagaaacctctcatcagctgttgtgtgacaaatgtcctcctggtacctacctaaaacaacactgtacagcaaagtggaagaccgtgtgcgccccttgccctgaccactactacacagacagctggcacaccagtgacgagtgtctatactgcagccccgtgtgcaaggagctgcagtacgtcaagcaggagtgcaatcgcacccacaaccgcgtgtgcgaatgcaaggaagggcgctaccttgagatagagttctgcttgaaacataggagctgccctcctgggatttg

SEQ ID NO: 26406 - DNA, 130 bp, Homo sapiens
  misc_feature 9, 32: n = A,T,C or G
gtgcaaagnatcttgagtatccccctcgtgcnattagttatccccaaaagtatatttcctacctagttatataccaaagctctgtgaagtaatttatgatacctccaaagtgaaaaacatcagataatgc

SEQ ID NO: 26407 - DNA, 263 bp, Homo sapiens
  misc_feature 24, 25, 101, 150, 155, 218, 254: n = A,T,C or G
ttacctcagctatatgactgcccnncattatgaaaacctgacggctatgatatactatgccttttctaaagatcaatactataacattgatgtgcctagtngaacagcaagagcaattactactcgttctgggcagaccttatccaaagnctggnacaactgtccttagactgatgagcaaaggaggagtcaactaatgaagaaatgaataataaatnttgacactgaaaaacattttattaataaagaatatngacatgagt

SEQ ID NO: 26408 - DNA, 134 bp, Homo sapiens
aacactagctctgtattaatccccatcattactggtaaagcctcatttgaatgtgtgaattcaatacaggctatgtaaaatttttactaatgtcattattttgaaaaaataaatttaaaaatacattcaaaatt

SEQ ID NO: 26409 - DNA, 311 bp, Homo sapiens
  misc_feature 103, 106, 219, 265, 274: n = A,T,C or G
gaggccttgaggcagccagcgcaggggcttctgctgagggggcaggcggagcttgaggaaaccgcagataagtttttttctctttgaaagatagagattaatncanctacttaaaaaatatagtcaataggttactaagatattgcttagcgttaagtttttaacgtaattttaatagcttaagattttaagagaaaatatgaagacttagaagagtancatgaggaaggaaaagataaaaggtttctaaaacatgacggaggtngagatgaancttcttcatggagtaaaaaatgtatttaaaagaaaat

SEQ ID NO: 26410 - DNA, 357 bp, Homo sapiens
gagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttat

SEQ ID NO: 26411 - DNA, 469 bp, Homo sapiens
  misc_feature 31, 103, 106, 221, 252, 268, 274, 312, 326, 348: n = A,T,C or G
gaggcattgaggcagccagcgcaggggcttntgctgagggggcaggcggagcttgaggaaaccgcagataagtttttttctctttgaaagatagagattaatncanctacttaaaaaatatagtcaataggttactaagatattgcttagcgttaagtttttaacgtaattttaatagcttaagattttaagagaaaatatgaagacttagaagagtaccntgaggaaggaaaagataaaaggtttctaaancatgacggaggttganatgaancttcttcatggagtaaaaaatgtatttaaaagaaaatngagagaaaggactncagagccccgaattaataccantagaagggcaatgcttttagattaaaatgaaggtgacttaaacagcttaaagtttagtttaaaagttgtagggtgattaaaataatttgaaggcgatcttttaaaaagagattaaaccgag

SEQ ID NO: 26412 - DNA, 458 bp, Homo sapiens
gaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtggacatttctgcaccaaaagtagatactaatgctccagatctgagccttgaaggacctgaagggaagttgaaaggcccgaagtttaagatgcctgagatgcacttcagagctcctaagatgtctttgccagatgttgacctggatcttaaaggacccaaaatga

SEQ ID NO: 26413 - DNA, 180 bp, Homo sapiens
  misc_feature 25: n = A,T,C or G
tctacaaaaacaaaacaaaacaaangctgggtgtggcggtgcacacctgttatgcctgcagtcctacctactcaggagtctgagctgggagatcacatgagcccaggagttcaagactgcagtgagctctgatcatgccactgtactccagcctgggagacagagtgagaccatttttcg

SEQ ID NO: 26414 - DNA, 482 bp, Homo sapiens
  misc_feature 4, 30, 108: n = A,T,C or G
aagnccaaataaaagtccgcagcgtttttntttgagggactgaaaaaggtagccccagcaaaactggaaagtactggggaaactggagggtgaatcttgggacagcanctccataaagttacttatgaactcctgagctcccccaagttgaaggaatctgtgtaatctgatctaaattgtattgacaataccatttataatagctcctctcaaattgaaagactttagtataaatctactaaaacattagagaatttgcatgctgaaaaactacaaagtgctgatgaaagaaatcaagatcaagtaaatggacagacataccatgttcatggattagaagactcaacgtagtaaatatggcagtgctctctaaattgatttatagatttaacatgattccaacagaggtctcagcagaatcttttgtaaatgtagacaaactgcttctaaaatttatatggcaagaaaaagaatttagaaaa

SEQ ID NO: 26415 - DNA, 320 bp, Homo sapiens
  misc_feature 25: n = A,T,C or G
acaccttatacaaaaatcaattcangatggattaaagacttaacaacgttagacctaaaaccataaaaaccctagaaggaaacctaggcaataccattcaggacataggcatgggcaaggacttcatgtctaagacaccaaaagcaatggcaacaaaagccagcattgaccaatgggatctaattaaactaaagagcttctgcacagcaaaagaaactaccatcagagtgaacaggcaacccacaaaatgggagaaaatcttcgcaacctactcatctgacaaagggctaatttgcagaatctacaatgaactcaaacat

SEQ ID NO: 26416 - DNA, 150 bp, Homo sapiens
attgggaactatcctcctggccccaccctgccccttctttttggttttgacatcattcatttccacctgggaatttctggtgccatgccagaaagaatgaggaacctgtattcctcttcttcgtgataatataatctctatttttttagg

SEQ ID NO: 26417 - DNA, 500 bp, Homo sapiens
tggtagtttttgtttctgtgggatcagtggtgatgtattctttatcattttttattctatttgattcttctctcttttcttctttattaatctggctagccgtctaggaatttttcccaagcaaatggaaagcaaaaaaaagcaggggttgcaatcctagtctctgataaacagactttaaaccaacaaaggtcaaaaaaagacaaagaagggcattacacaatggtaaagatatcaatgcaacaaaaagagctaactatcctaaatatatatgcaccaaatacaggagcacccagattcataaagcaagttcttagagacctacaaagagacttagactcccacacaataatagtgggagactttaacacttcgctgtcaatattagacagatcaatgagacagcaaattaataaggatattcaggacttgaactcagctctggaccaagcagacctaatagacatctacagaactctccaccccaaatcaacagaata

SEQ ID NO: 26418 - DNA, 149 bp, Homo sapiens
  misc_feature 6, 31: n = A,T,C or G
gagctncaacttcttacttccctactgaaantaagaatctgaatatacatttgttttctcaaatatttgctatgagaggttgatggattaattaaataagtcaattcctggaatgtgagagagcaaataaagacctgagaaccttccag

SEQ ID NO: 26419 - DNA, 393 bp, Homo sapiens
  misc_feature 2, 3: n = A,T,C or G
anncaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttga

SEQ ID NO: 26420 - DNA, 227 bp, Homo sapiens
aatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagc

SEQ ID NO: 26421 - DNA, 451 bp, Homo sapiens
  misc_feature 6, 8, 30: n = A,T,C or G
agcatncncacttgttccttaattagggantttcatgaacggctaaacgagggtcccactgtctcttatctttaatcagtgaaattgacctttcagtgaagaggctgaaatataataataagacgagaagaccctatggagcttaaattatataacttatctatttaatttattaaacctaatggcccaaaaactatagtataagtttgaaatttcggttggggtgacctcggagaataaaaaatcctccgaatgattataacctagacttacaagtcaaagtaaaatcaacatatcttattgacccagatatattttgatcaacggaccaagttaccctagggataacagcgcaatcctatttaagagttcatatcgacaattagggtttacgacctcgatgttggatcaggacatcccaatggtgtagaagctattaatggttcgtttg

SEQ ID NO: 26422 - DNA, 100 bp, Homo sapiens
  misc_feature 27, 37, 43, 49, 52, 61, 81: n = A,T,C or G
cactacgtgaggaacagaagaattganaacctgtccntacccnattacncgngctagaggnatgcacgccatacaaaaacnggacctctaccgagagagg

SEQ ID NO: 26423 - DNA, 490 bp, Homo sapiens
  misc_feature 6, 55, 222: n = A,T,C or G
aatccngaggggaaaaagatccattcttttttccttgtggagaaaagctaaatancctttaagaatgtgggtggtattggagaaagaagatgaattatagctccggagaatcaagatcttaagtgaagcctttctgttcagatgtgatctataaaaaatcataatttggggaaagtttaagcaaatctggctttgtagtcctgatgttataagtgactttgngatcaaactgtcaggcttgggttcttgttatagaatgcttggtatagaaaaaccatgccatcattaatggctaacaacacgtagggacttcatgtcatgtcaaagatagctctttgcaagtgccttgattaaaccagaaaactgtcatcgtttaacccaaatatctgaatggtcatctggtaactcatgggtttttggcctcataagatggtccactctgtacacaggcattcctcctgcaataatgttgtatcttttgagaccgttg

SEQ ID NO: 26424 - DNA, 495 bp, Homo sapiens
gcttcaatttttatttccctagacctagcaatatatctgtctccaaacagaagctaagtaaaactttgttgaatttcactctgttatctctgcagtgtcctcaacaactccatatgaaggtgaacgtagacattattatacctgttttataaaggaggaaattgaaatacaaaagtgtccagattcacccacctaggctccaggacattagacttctgggctaataattctcctctgattgtactatagtgcttagaaaacttggggacaggaatttttggagaacttacagaattcagaatgaagccaagcaattgcaagttatcaataagcaagccacttatatattatctactgcagaggaccagcaagtgaattacattagatttataatcctaacttttccttgcctttccttgtccacttagaatcagtaagagttatgtcaggtatatttgaaaatctgctaacttagaaacttgtcttcaaatcagg

SEQ ID NO: 26425 - DNA, 234 bp, Homo sapiens
agtttaattagctttgcagactgatggcatcaaggtaaatatatttttgccaaagttctggccttccaaaactcacccccttatttaaatgtgtgctatgacccactatgacacagcatctgcattttctaaaaaattccatgcaggtgttttggggagaggtattttttaagcaatgaaaattcaactgagtacaaagccccctcttggggggttggggaagtctcttttttg

SEQ ID NO: 26426 - DNA, 196 bp, Homo sapiens
atggcccaggtatttggaggtggcgccaacagcctcttcctggagaagacaccctttgtggaaggcctcagctacaacctgaacaccatgcagtatcccagccagcagttccagcccgtggtgctggccaactgaccatctacctgcccgtggggccaggagcacccaagaccacagaaaagagaaaggaaaggcc

SEQ ID NO: 26427 - DNA, 248 bp, Homo sapiens
agaattaggcaaatttgcaggatacaagattggcacacagaaatcagttgtatttctttaaataattattctaagcaatccataaatgatgttaagaaggttccatatacaatagcatcaaaaagaataggggcccagtgcagtggctcacacctataatcccagcactttcggaggtcgaggcgtgcagatcacgaggtcagcagtttgagaccagcctggccaacttggtgaaaccccatctccac

SEQ ID NO: 26428 - DNA, 478 bp, Homo sapiens
  misc_feature 6, 7: n = A,T,C or G
gaactnntaagttttttaaaaaaaatctttttataaatctttgttaattcttgatatgaagtattaccaagatttcagtaagaggttttttgaatctatttcttttaaaaaaatgaattgtttatgacactgaacattttattcccagatgctttgttgactaatgttgaccagattgtccaggaaacacagaggctggagttaatctgaagagcaccacttctcctctctctcctgaaaaaatttgccactgatatttttactggataaaattcaaaaatgtttcaattcacaaaggctaattgttgaactggtgtcgtagaagaaattgtctacaggagccaaggtgaaagtctctgatgacggcggaactggctccattagaccatggttcatcctcttttaaaaccaaatttttttttcttctggcctacaagtatttttttttaaaaaagaaaaaaagcctacattggcatca

SEQ ID NO: 26429 - DNA, 490 bp, Homo sapiens
  misc_feature 29, 55, 137: n = A,T,C or G
gcccgccagaagaggctgccccagcagtnttcgggctctcccggcaggggcgatncttcagtacctctgtggtcagaccgtttgccaagcttgtgaggcctcctgttcaggtatacggtattgaaggtcgctatgcnacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaagagagaggttctctcccctcactaccaacctgatcaatttgcttgctgaaaatggtcgattaagcaatacccaaggagtcgtttctgccttttctaccatgatgagtgtccatcgcggagaggtacctttgcacagtgacctctgcatctcctttagaagaagccacactctctgaattaaaaactg

SEQ ID NO: 26430 - DNA, 108 bp, Homo sapiens
gaaaggggtcggctgaccatgctcatctgctggtccgtgggacggtgcccaagccagaggctgggttcatttgtgtaacgacaataaacggtacttgtcatttcggac

SEQ ID NO: 26431 - DNA, 402 bp, Homo sapiens
  misc_feature 31, 60, 61, 63: n = A,T,C or G
tatcatagaaaagtactacacgcgcctgggnaacgacttccacacgaacaagcgcgtgtnnanggagatcgccattatccccagcaaaaagctccgaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgg

SEQ ID NO: 26432 - DNA, 478 bp, Homo sapiens
  misc_feature 31: n = A,T,C or G
aagctcctcgttgggcagaagtttagcattnttagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagattttatcattttttttctctctcggcattctttttttctcatactcttc

SEQ ID NO: 26433 - DNA, 500 bp, Homo sapiens
  misc_feature 11, 491: n = A,T,C or G
tatggccgganttggccttccaatacatagggagagagtttagttcttaataataatggtcagtcataaggtgtagcatctgactctgttaatttaaaatgacagaattgattcaagggtattacatcaagaatggaaaacaattgtgaataataagggacacttgattcttattccttggttttgtagagactggtaatattggaagaaatggaaatataataactaatgactattatctattttccaaagaaatgtgaatatgatactgtgcagatacgtgattttagaaagagagatggggaaggggaggaagagactgagattattctattattgttttcttttctaaaccatgcatatgtatcttggtctcatttttatacttgtaactttacatttttattgtttttagagcctcctttggtgaataaacagaaatgaaaaggtgaaaatcaaatcaactttgttactccttagttcttaaaagntcaatattt

SEQ ID NO: 26434 - DNA, 467 bp, Homo sapiens
  misc_feature 41, 44: n = A,T,C or G
tatggcccgggatgtacccggctgacagagaagattcccgnttntaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctagcccgcaatactgtaggaacaagca

SEQ ID NO: 26435 - DNA, 311 bp, Homo sapiens
  misc_feature 28: n = A,T,C or G
gaagcccctcctgaaaactgcagcttcnttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtccctgcagatgacaggaaagtcaag

SEQ ID NO: 26436 - DNA, 490 bp, Homo sapiens
  misc_feature 30: n = A,T,C or G
aacatcacagttacttggttagacatcatntctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttc

SEQ ID NO: 26437 - DNA, 362 bp, Homo sapiens
  misc_feature 6, 31: n = A,T,C or G
aacatncataatgggagtcatacatcttatntagaagcaaatacatacttaagggattttaatctattaaaaaatgcaaggatggccaggtgcagtggctcgtgcctataatcccagcactttgggagagaggcgggcagatcatatgaggccaggagtttgagaccagcctggccaacatagtgaaaccccatctctactaaaaatacaaaaattagccgggtgtggtggtgcacacctgtaatcccagctatttgggaagctgaggcacgagaatcacttgaactagggaggaggaggttgcaacaagccaagattgcgccactgcactccagcctgggcagcaaagcaagaccctgtct

SEQ ID NO: 26438 - DNA, 100 bp, Homo sapiens
  misc_feature 58, 85, 86: n = A,T,C or G
aatatttgagagaagtgccctttatatgaaggaccaactatctcttccctccctgggnaattttcacaatataataaatattttnnagttatataggcca

SEQ ID NO: 26439 - DNA, 413 bp, Homo sapiens
  misc_feature 7, 24, 26, 47, 52, 84, 86, 92, 201, 222, 233, 256, 275, 339,401: n = A,T,C or G
accaaancggcttcttattcgggngngagttttttcagcaacccggnccagnactgggagatacagccctccaccttcagatgngnctacgngcgctctgccattcaactcggaaactataagtaattctcaagaaagccctcatttttataacctggcaaaatcttgtgaatgtcattgctaaaaaataaataaaagctngatactggaaacctaactgcnatgtggatgtnttacccacatgacttattatgcntaaagccaaatttccagtntaagtaattgcctacaataaaaagaaattttgcctgccattttcagaatcatcttttgaagctntctgttgatgttaactgagctactagagatattcttatttcactaaatgtaaaatttggagnaaatatatatgc

SEQ ID NO: 26440 - DNA, 490 bp, Homo sapiens
gttttcaaagaaagctctgattttgtttcattttcagctggagacttaaatgacaccaagcaaagcctacttagtttagatctccagaaattggctggtggaaaaaaatcaaacatgaagattgcagttttgttttgtttttttctgcttatcattttccaaactgactttggaaaaaatgaagaaattcctaggaagcaaaggaggaagatctaccacagaaggttgaggaaaagttcaacctcacacaagcacagatcaaacagacagcttggaattccgcaaacaacagtttttacaccagtagcaagacttcctattgttaactttgattatagcatggaggaaaagtttgaatccttttcaagttttcctggagtagaatcaagctataatgtgttaccaggaaagaagggacactgtttggtaaagggcataaccatgtacaacaaagctgtgtggtcgcctgagccctgactacctgcctctg

SEQ ID NO: 26441 - DNA, 431 bp, Homo sapiens
  misc_feature 52, 62, 318: n = A,T,C or G
attcctagtaaaccaagtaaaataagtgttggagtaacacttgcttaaaagnaatttaaggngtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttnaggtagattatgctgcatcctcgtggcaaaattctgtattcttagtgattgttacaaacccctttattgctgtctgagaaagtgaaagattgtgtatttctattaaaacattt

SEQ ID NO: 26442 - DNA, 432 bp, Homo sapiens
  misc_feature 7, 336, 391, 409, 429: n = A,T,C or G
gtttacncagtgtctgagacatttacattatagataagtagtacatggtggataacttctacttttaggaggactactctcttctgacaggtatgtttcatgtctatcttacaagtatcgatgtatactttacagtcaatactaaggagacattaatgttattaataaatgcttataaataataggataaagtccaaagtttatctctataatttcttaaaaatcagcatttaaatacaaacctaaatttgtacctaaaattattctagttttatgtcttacctataatgaatgtattttaaatataattatgtgacttttttttttcagctaagngaaaacctgtcattatgccttaccataaatgttaacatgattgattttaaaaagncatctaaataaacatctngatggttatcctaggaaaanaac

SEQ ID NO: 26443 - DNA, 500 bp, Homo sapiens
  misc_feature 7, 24, 32, 42, 48, 51, 59, 103, 104, 114, 142, 154, 178,183, 224, 435: n = A,T,C or G
ctcggtnttatggccggccagatnaaagattnaggggtgaanaaaacngcngtaggatntattaaactacagcgttgtacaattagcttagtaacactatggnntgagctaaancatatcacagtttttacatgggccaaancatgaattgagnatgtgggcacattgaaaacacggntgaangaataaaacactctttggtggcgcttgaggcatcattaganggcccagacgatttccactattcacagcatttccttttctcagaaggactctttatatttccatgtaaatctagatctttggagcaattaagatggaattacaatttctagggagcattttaaggaaaatgttttggctttttcataattttatgtcttacagtatggaattataatacgaaaatctttatatgagttttggcttcttggnatttgtacttattcaggggaaaaagtctttcgattacttatgcctctatagagcttaatttcttg

SEQ ID NO: 26444 - DNA, 472 bp, Homo sapiens
  misc_feature 10, 53: n = A,T,C or G
atgacacttnaaaatattccttccttcaatttgacccagcgcctcgtgggggngagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaag

SEQ ID NO: 26445 - DNA, 298 bp, Homo sapiens
  misc_feature 2, 7, 297: n = A,T,C or G
gnagaanctggaatcctcatacattactgggggggaatataaaatgatatagtaatttgaaaaaagtttggcagtatcttaaaatactaaacaaatttactgtatgacctagtaattgcagtcctaggtatctacctaacaggagtgaaaatacccatctacacaaagacatgtacacaaatatctatagtagcattattcataatagccaaaaaatggaaacaatccaaatgcccaccaactgatgaatgaataaacaaaatgtggtatttcaggacagtggaaataatccatgang

SEQ ID NO: 26446 - DNA, 303 bp, Homo sapiens
  misc_feature 1, 250, 254: n = A,T,C or G
ntgtggagaggtcttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttttgggancacntggaaaaaaaaccattttttatttaattaaagaatattgacatgggttt

SEQ ID NO: 26447 - DNA, 390 bp, Homo sapiens
  misc_feature 297, 355: n = A,T,C or G
atggccggatcaacaacagtgttctaactcatccctgatgggctgtgagatgtagactattacacaagaattcaagttactcgtaagcaacttttagatagagttggtcctgttaggaggagactcttgatgtcaccttcagtatcttgaaagcgggtcccctccccgaggctcttaattctttgaaaacttgatgctgtttcagcttgaaaaattagcaagactgttaaaaaaaaaaagttgaggggagctgtttaagaaactgaaaagtaattgcaaactacattggataattgngactttcagttgttgttctgtatcagttgaatttttgtgctcttttccctgtgtacgngggggttctatttttctccaataaaacttttattt

SEQ ID NO: 26448 - DNA, 254 bp, Homo sapiens
  misc_feature 1, 10: n = A,T,C or G
ntgaaatttnctcaggcgtctggctccagagccaacacttgtcctttttactcctgagaaggtgatgaatacttagcacaactcctggtatatagtaagtgttcacttcagtattttttattgatacttatcctcattagactcattcacagaaggaggcacttttctaattgtttccctaggtttttgaatttggggatttggatttttctggaacgtggagctctttcactgaccatgataagcagaatagc

SEQ ID NO: 26449 - DNA, 236 bp, Homo sapiens
gactaggaaaggttagagaacatggaaagaaaatttaacaggttaattttaaggtaataagaccattgtattgatatattcttcagtgtgatttaggtgagtcaggaatttttcctctggagactgcctaaatcagggatgtccaatcttttggcttccctgggccatactggaagaataagaattgtctcaggccacgcataaagtacactaacactaatgatagctgattagcg

SEQ ID NO: 26450 - DNA, 256 bp, Homo sapiens
  misc_feature 52, 82, 90, 107, 118, 149, 171, 205, 245: n = A,T,C or G
gcagggaatttttgtttaattccctactgtatgcccagcaccttacaacagngctgggcttatagtagatactcaataaatncaattgantaaataaatgaaaaaangcttttatggngatccattacattatgtttttgaatgagtancttgaaatttaagtagcttagngatggataaataagtttagaagaaaaatagtggngaactataatacaactaacaagttaaaaaacaaatcaatngattttcctct

SEQ ID NO: 26451 - DNA, 497 bp, Homo sapiens
  misc_feature 1, 373: n = A,T,C or G
natggcgggggagacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcaggacccagcttagagttcttctttctttcttaagccctttgctctggaggaagttctccagcttcagctcaacccacagcttctccaagcatcaccctgggagtttcctgagggttttctcataaatgagggctgcacattgcctgttctgcttcgaagtattcaataccgctcagtattttaaatgaagtgattctaagatttggnttgggatcaataggaaagcatatgcagccaaccaagatgcaaatgttttgaaatgatatgaccaaaattttaagtaggaaagtcacccaaacacttctgctttcacttaagggtctggcccgca

SEQ ID NO: 26452 - DNA, 498 bp, Homo sapiens
  misc_feature 1, 7, 37: n = A,T,C or G
natggcnggagttggcctaaaaataaaagccccttgnccctctaagaaacttcaaaatatagcatgtactatagtgtggagggaaaaaaaggcaaatcagtgattccagtgtgaatgtgtttctaatcagcatagattaaaattttaaagtatacattaaggtgtaagagtgttcttagatagaatattttctgcatcttcaaagagtattcaagagaataaggagtacttctttctagattcctttttctatttatttcagtcttttccatgagctggaaaactgtgaaatattgactcttgaacaaaagcatgttgtctttttgttaactcattcttaaacaactccagacacacatttatccaccacctaccttttcagtttctatataggcagtaagcgtgttcttaaaaatcccaagacttcagttaccacctctatggcaacatgatttcctaatgcacagctcggagtgccaatctcttcagaactctggt

SEQ ID NO: 26453 - DNA, 276 bp, Homo sapiens
gaaagaagggtttaggttggaatttcagtaagaaggtactaattacaacgtgcttggttggaagttggtgccaggccagggcttggagagaccatgggaaaatcacctgtctccctgccttctccctgagttagtttgccacagaagatccaacagccagactggtttgcaccgacggttcccaaatgcatggattggcactctgggctgttacacccgccacagctgctcggagaacttgtctccttgcttcgggggagggtcgacattttaatt

SEQ ID NO: 26454 - DNA, 225 bp, Homo sapiens
  misc_feature 39: n = A,T,C or G
aagatcaaaagggacaagcatcaagcacgcaacaatgcngctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctc

SEQ ID NO: 26455 - DNA, 286 bp, Homo sapiens
cagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatactcgtcactgcctatacctgcagctgaactgaatggtacttcgtatgttaatagttgttctgataaatcatgcaattaaagtaaagtgatgcaac

SEQ ID NO: 26456 - DNA, 405 bp, Homo sapiens
cagccttggacaggaggttttatttaatgtaatgaaggcttactctttagtagatcgtgaggttggttactgtcaaggaagtgcttttatagttggattgttgcttatgcagatgccaagaagaagaagctttctgtgtatttgttaaattaatgcaagattatagacttcgtgaactttttaaaccaagtatggcagaattgggcctttgtatgtaccagtttgaatgtatgatacaggagcatcttccagagctctttgtacattttcaatctcagagttttcatacctcaatgtatgcatcatcctggtttctgactatctttcttacaacttttccactaccagttgcaacaaggatatttgatatctttatgtctgagggtttagaaatagtgtttcgtg

SEQ ID NO: 26457 - DNA, 241 bp, Homo sapiens
  misc_feature 241: n = A,T,C or G
atcctataatctttgtgctctcactgcatttccctttgggttccatgttttccttgttcccttccatgcctagctggattccagagttaagtttatgattatgaaataaaaattaaatcacacaaaaaaagaaataacaccaacttttatcaaactattccaaaaaattgaagaggaaggaattcttcttaactcattctgtgatgccagcattaccctgatacaaaactagacataatcn

SEQ ID NO: 26458 - DNA, 315 bp, Homo sapiens
  misc_feature 4, 16, 36, 43, 97, 100, 188: n = A,T,C or G
tccngggtatttggcntttatggcgggatataggcnaagttgncagggtgtggtggctcgacatgtaatcccaacactttgggagaccaaggcgggnggntcacctcaggtcgggagttctgagaccagcctgatcaacatggagaaaacccgtctctaccaaatatacaaaattacccaggcatggnggtgcatgccttgtaatcctagctactcgggaggctgaggagggagaatcactttgaacccaggaggtggaggttgctgtgaaccaagattgcgcccttgacaacaagagtgaaactccatccatct

SEQ ID NO: 26459 - DNA, 236 bp, Homo sapiens
gtgactgacataaacgggaataagacgtgtgatgagattgcttctgagggtcaagtagagattggtggagaggctgggagtacagaggttccttgccaggagtagcatcacagggatcccacttgacccctactaaggaaggtgaatggctgaagaagggagggaggatgaaaaggtacagacttatcccttgttcatggatcagcagagggacattttgtaaaactggcttgtcc

SEQ ID NO: 26460 - DNA, 449 bp, Homo sapiens
  misc_feature 9: n = A,T,C or G
aaagaagangtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggagg

SEQ ID NO: 26461 - DNA, 245 bp, Homo sapiens
cagcgggtcattcagaaacttttagacttttgtaggcaaggaaaattcccttctaaaaactagcagacaaggatagagatttcaattcttaattttgccagaaaggaacattttgcaaagcgtgccataagcatacagaccctgcccttgggaattttacagtctactgtaacaccaataaagcaaaaaattacaacttaacaaataaggacagtccattaaaataaaaagcattagttttatgc

SEQ ID NO: 26462 - DNA, 184 bp, Homo sapiens
  misc_feature 2: n = A,T,C or G
gnttctttgttttgttttgttttgctttttgttaaaacatgtctatagagttggcagttaatgctgaatttgtcaaataccccttccaaaattatacttgtatttaaaaaataaatggatctacctaatttctattgatttaatctgcagttttgtcttattaaagtggtatgtttttcagtgc

SEQ ID NO: 26463 - DNA, 174 bp, Homo sapiens
  misc_feature 173: n = A,T,C or G
acatgtagaagcaaatgatgctggctataggcggtggctcatgtctataatcccagcattttgggaggccaacgtgggcagatcacttgagcccaggagttcgagaccagcctaggcaaaatagtgaaacctgcgtctctacaaaaaagcagaaaaaattactttggtgtggng

SEQ ID NO: 26464 - DNA, 490 bp, Homo sapiens
  misc_feature 29: n = A,T,C or G
gaatccagtgatggctccaatgaagctgntggtatctaccaagtcctagaaataccatatgaaggagatgaaataagcatgatgctggtgctgtccagacaggaagttcctcttgctactctggagccattagtcaaagcacagctggttgaagaatgggcaaactctgtgaagaagcaaaaagtagaagtataccagcccaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctat

SEQ ID NO: 26465 - DNA, 483 bp, Homo sapiens
  misc_feature 8, 466: n = A,T,C or G
aaacttanacaggtaaacagcacgtattctaggaatgaaaaccaacaagggacagccttataagcaggatgtgtgtgcttccttcctttttatttctgtctttctgtcccattcacccatctattcatccatccctccatctgcccatctgttaacccacttatcttcctttcactgttctgatttatttatacttattttagttacttgaggaaatactaaaatgtaatagattctagaatctttcagaaattgttggctgtgagtttttactattcttgtatacgaagagtgggtggagaagggatatcaggtcttttctctaccggattttccactcaaaagtgttgattttctttaaagatcaacttgcagtattccgttttaatttgtttagatatttacgtgctacaagtaattttacactgagctattctttcattttatgtgttttattatatggggntggtctgtatgtttaga

SEQ ID NO: 26466 - DNA, 381 bp, Homo sapiens
  misc_feature 5, 29, 360, 371, 375: n = A,T,C or G
aactngaggaaacccattggtgatggtgncagtaggaagaatgatcgtggtgaggggaagagaaaaaagtaatgctctatccccaggggtggggtatggaatatatgctaggatttgcacaacaattggagaaagttgcaggagcacttgtgaaggccacattgctgatacagaggtacacattacctacctaagactgagtcttaatcagaacatcaaggaatgcccttcctccctggcctgctaccaacaacctaacaagtgttgagtaaaaataatatgggaatatggttgaatatggaagaaattcaagagacacattctctttagggcccagcattaagggaagacccaaagctnaagggggagcnaatnttaaga

SEQ ID NO: 26467 - DNA, 486 bp, Homo sapiens
  misc_feature 13: n = A,T,C or G
gaaacacttcagnaactgctgctataaagaaattctctaattggttgaatttttttttaagtaaatagtactttaggccaaaatttatatgaatatttgatcttcttgagattttcatactatcatttaaccaccaggaagctgaagtgtgtgaagtacaaagctgacagcactttattttattgctctccattatttggtattcattatattccttcagtcagaaaattattactctctatggcactgttttttatcacaaatatgtatatgtgatattgatatataactatatatattgccatcacacacgaacaataaaataaagtgttctattaacctgatctctttgcccttttgctatgtgaggagtgaatgagtggccttctgatgctctgactcttctctgtatgtcaaactcatccctggcacaagaaattccagtcatgtgaagcaaactgccctttgtcctcaaagaaattgttg

SEQ ID NO: 26468 - DNA, 452 bp, Homo sapiens
  misc_feature 269, 365: n = A,T,C or G
atgaattttcaatttttttttttctgaaacagtacaatataaactgaaataagatctattacaaaggtaactttttcctagtctgttcatgggattcttaagtgcacataaccacagaatcaaataataatctaataatattaagccacttaaaaatatagacttgaggccaggcgccatggctcatgcctgtaatcccagcactttggggggccaacgcaggcagatcacttgaggtcaggagttcaagactggctggccaacatggngaaaccctgtctctactaggaatgcaaggattggccggacgtggtggtgtgcaccacgtagtagtgtcccagctactcgggaggctgaggcagganaatcacttgaagtggcaggcggagatcacgatgagccgagattgcgccactgcactccagcctgggcaacagagcaagactccatct

SEQ ID NO: 26469 - DNA, 209 bp, Homo sapiens
gaacagcagcaataaacttccaattatatgatttcatgcaaattaagattatattagtctccttcaagccacttaaaaactaaaaagtcagctgggtgtggtggctcacgcctgtaatcctagtgctttgggaggccaaggcaggcagatcacctgaggtcaggagttcgagaccagcctggtcaacatggcgaaaacctgtctctact

SEQ ID NO: 26470 - DNA, 489 bp, Homo sapiens
  misc_feature 34: n = A,T,C or G
atggagcagagaattgaaaaagtggagcattcantacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcgacttagaggtggggagcagagaattctcttatccaacatcaacatcttggtcagatttgaactcttcgatctcttgcac

SEQ ID NO: 26471 - DNA, 305 bp, Homo sapiens
aattagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaaggaaaaaaac

SEQ ID NO: 26472 - DNA, 120 bp, Homo sapiens
  misc_feature 7: n = A,T,C or G
atctganccttcagcaagtcattatcttttagctggtagagtgtcttgcctccatgtggatgactgctcacccattagtgtggtggttgctgaaggttggggtaacctggcaattttttt

SEQ ID NO: 26473 - DNA, 289 bp, Homo sapiens
gaaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagc

SEQ ID NO: 26474 - DNA, 463 bp, Homo sapiens
  misc_feature 9, 10, 12, 21, 26, 56, 93, 223, 297, 303, 368: n = A,T,C or G
gaacccacnntntgggagaanatctntacaatctatacatctgactaaggaagtantatccagtaatctacacagaattcaaacaaatcagcngaagaaacaatcccaccaaaaagtgggctaaggacatgaataggccattctcaaaagaagatatagaaatggctgacaagcatatggaaaaatgctcaacatcacaaattatcagggaaatgcctatcanaaccacagtgtgataccatcttactcctgcaagaatggccatactaaaaataaaaaaatagatattggtgtggntgtggngaaaagggaacacttttatactgttgttgagaatgtaaattagtacaaccactataaaaaacagngtggagattccttaaggaactaaaagtagatctaccatttgacccagcaatcccactactaggtatctacccagaggaaaagaagtcattatagg

SEQ ID NO: 26475 - DNA, 461 bp, Homo sapiens
atagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttc

SEQ ID NO: 26476 - DNA, 464 bp, Homo sapiens
agttttcaaaaatgtaatgctaaactttataaattattctttaaaaccttaaaacttaggatcttctgggatattaggctaaggaaaagcatgaaatagtagataaattatatttcaggttcttcaagctcagcatcaccctatgtatacaaaatctgaccttgcttaatattctgggataattctcctcattatccttcttagtcttcctacttcatatcttcaaaattattaaaactgtgctggtttgaatgttcttacactagttatcatgcatgcttatacttacacacaatctcatccatacatgactgttcattaaatatttacaaataatgtgtatatatacaagaaagatgacatttatgatgattcccaagaagctgaagttatccagtctctgctggatgttgtggatgaggaagcccagaatcttttaaacgaaaataatgcagcaggagact

SEQ ID NO: 26477 - DNA, 465 bp, Homo sapiens
  misc_feature 19: n = A,T,C or G
atttggatggaaaaatatnaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaattgagcagatacacaaatgagaaaggaaaaggaacaaaagattatcactacagaaaaccaaaaaaattgcaaagaaaaacaatgagaggaaacaaaagtatacaaatcagtcagaaaacaataaaatgacaggagtaagtccacacctattgataacaatcttgaatgtaggtaatttaaatttcccaaatgaaagatagatactggctaaatgaattaaaaaaataaaacccaattacatgctgcctataagaaactgactt

SEQ ID NO: 26478 - DNA, 419 bp, Homo sapiens
gataaccaagctaatatagcaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccta

SEQ ID NO: 26479 - DNA, 128 bp, Homo sapiens
  misc_feature 10: n = A,T,C or G
aactcttagnattgtatgttcctggagggcagaatatgcccattcatatttgtatcttcttccttctgctcttggcacctaacacagtgccttgcacacaaacaataaatgattgttgagtgaataag

SEQ ID NO: 26480 - DNA, 490 bp, Homo sapiens
  misc_feature 30: n = A,T,C or G
gttaccgtttcattagtagtatggttgtgnggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgccttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgaaaggttaatttctgctcaagtggtaccacttaaaggcatgtattcttttagtatgtaaaatgaaatagtaccttgagtttaaata

SEQ ID NO: 26481 - DNA, 296 bp, Homo sapiens
gtttttaggaagttgcagtgggattaatgtcaattggaagggatgcagcaagtttagagaaggtgttggcactaacgctgcttgtttggcaaatcatcactgaggtattccacccagagactttttcaaaaaagtcaactaaagtgctaagtcataagaggagagccattatacccgttgtctttctgggctccttgagtttatctggattccaacagcacttggaaagtaccgccctccactacctcaaatgcaaacacaatctctgccagtagacattggaattagacttagtg

SEQ ID NO: 26482 - DNA, 467 bp, Homo sapiens
  misc_feature 11: n = A,T,C or G
gtctttttttnggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggc

SEQ ID NO: 26483 - DNA, 162 bp, Homo sapiens
  misc_feature 6: n = A,T,C or G
tgtgtnttcaaatatgtagtttgcctttttggttgttgtaccctgctcactctccttcacacagaacctttcatttattgtacaacatcacactcaccctaacctactggcggacagcgatcccagtttgccttgcaaaataaactctgtttatgtgaattt

SEQ ID NO: 26484 - DNA, 468 bp, Homo sapiens
  misc_feature 28: n = A,T,C or G
agcaaatcagatagcaatatagacattnacagcagctctgtggataccatgtaattgtcaggtaatttcagaatgttgaaaattattcagtgcagccctcatagtatcatacttgaagaaattgattacagttccactaaattgttgaagataaattatttttaaaggttatgaaaactaagttatattaattcatatgtttgatttttaaatcccacctcctcaagctatccaattttctgactttgaaaataaccatgagagatgccacatttctctctgggaaactaccactcaaagaataattgttaaaaattaagcttttaggtattagaagctgttataaagtataaaattaagatataagcagatcacatgtaaatcattcctaaagcacaagaaaagaatgtgccttgatgtacatatattactaagttgcctctcccagtttactttaaaaatggcttt

SEQ ID NO: 26485 - DNA, 490 bp, Homo sapiens
  misc_feature 7, 32: n = A,T,C or G
caggtcncaagattttaacttctaaatgctanaaatattactgaatacttgaaaacaaatttcactgtgtaacccttttagctgtttcttctggattaagggtagtgtaggattcagttttcctagaatctttagaagactgtaaaattggtgataaattctcagttcagttcttatgaaaaagatatggattcatattataaatatatattacgagaaaaaatagggagctaaacttggaacagattggatttcccaaagaggactctggggaaagctatctttatttgccactgtagcaaattaagagcacacagtgaactgttctaacactgaatgccatttgaagagtaaaacaaaagaactagccatggcttcctcatctgttgcctgaatggttggcttctttaaataattttcctggcctctctcctctcattgagtgatgtcactgatgccacagaaagatgagtaatagactcctgtggtc

SEQ ID NO: 26486 - DNA, 449 bp, Homo sapiens
  misc_feature 210, 232, 353, 357, 360: n = A,T,C or G
tacacacaagcgggctcactcgggaagataatccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccantgcagccccgaccctgagccgngtgcaggggcaaccttcggattccttatactctctctgaaggcaaagatggggacaaggactaagagtcagaatgttgacactttgatgaaatgggagtagaagaaatgcattctgtaagnggtnaanggacatttgactgtttacttttctccacactaagtcttctccatgttttgtggccttcggttgtaataaacttggcttctttatcaatt

SEQ ID NO: 26487 - DNA, 390 bp, Homo sapiens
  misc_feature 31: n = A,T,C or G
atagcaaggactaacccctataccttctgcntaatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccgagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctc

SEQ ID NO: 26488 - DNA, 124 bp, Homo sapiens
  misc_feature 12: n = A,T,C or G
atcactccaagnaaagagatccacataccattctcaatcccactgaaattgctggcattctcaaaggcagggcagagggggatctggggtagaggagggttctgtctaatcttttttttttttt

SEQ ID NO: 26489 - DNA, 235 bp, Homo sapiens
  misc_feature 39: n = A,T,C or G
caatttcccaatgtacctataagaaatgtgcatcaagcnagcctgaccaacatggtgaaaccccatctgtactaaacataaaaaaattagcctggcatggtggtgtaccgcctgtaatcccagtgacttgggaggctgaggcaggagaatcgcttgaacccgggaggcggaggttgcaagtgagctaagatcgcgccactgtactccagcctgggcaacagcgagactccatctc

SEQ ID NO: 26490 - DNA, 474 bp, Homo sapiens
  misc_feature 471: n = A,T,C or G
gaggccttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggngat

SEQ ID NO: 26491 - DNA, 470 bp, Homo sapiens
ataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatattttagtggccatttattatcaatggtaacacaatggagtactaagatggtatttgcacatttaag

SEQ ID NO: 26492 - DNA, 488 bp, Homo sapiens
  misc_feature 1, 4, 57: n = A,T,C or G
nttncgaaatcctgtgttaaatattgctattttttcttagcagttatttctacagcntaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagg

SEQ ID NO: 26493 - DNA, 174 bp, Homo sapiens
  misc_feature 41: n = A,T,C or G
atttcaaatttgatgaacattgtatatccacaagcacaagnacgctcaataaacttgaactataaacaaagaaatctgaagacactacactgaggcatgtcaaaattaaattgctcaaaaccgttaatagggagacaatcttaaaaagcatctagagaaaaaaccgtatactgt

SEQ ID NO: 26494 - DNA, 384 bp, Homo sapiens
  misc_feature 11: n = A,T,C or G
gtcattttttnggttcattagaaaggaagttttgttcactacaaattaaaaaattcctcaagccaagcatcactaagaaaacacgagctcttgtaaatgtgttttattcaaagtatgatgaaacaagattttaaaaattatctttaattatgcaatgtagcattgccatagttttcagtaaataagcatttctttcttggtcatctacagagtattcattatagtctaccaaatgcctttgtctactcagccaagtttattctaagtttgtgcacttcgtgtggagttacaatattgttcccagtattaatatgttttatttctaatgtgtattagtttgaatggcccaaaagttactgtaaaataatttttttacaatgaagg

SEQ ID NO: 26495 - DNA, 455 bp, Homo sapiens
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 26496 - DNA, 466 bp, Homo sapiens
atataaataaatggctacatagagaaaagggggagaagatacaaaaatacagaattgcagatgatattcacagatactcaaggatgagcatagctccctgctccttaaatgtgggctccacatagcaacttacctccaaacagtatacacggaaaggggaagaaagaataacttcatagtggagaaacctgacaaacactacttctgttaactgtgaacgcagttgacatcgacagtgacaggtcatggtggtggcatatactcttgataggatgtaatgaaagtggcacttcacctttgaggtcttgctccctcaaacccataacctaaaacatcagacaaatcccagctgaggaacattctacaaaatacctgaccaatactccttgaaatcatcaagatcatcaaaaacaagaaaagtctgagaaactgtcacagccaagggagacctaagaagacatgatgg

SEQ ID NO: 26497 - DNA, 467 bp, Homo sapiens
aagaacaacttgatgaaaaatcttcacaactggatgaggtacttgagaagttggaaaggcacaatgaaagaaaagaaaaactaaaacaacagttgaaaggaaaggaagtagaacttgaagaaatcagaaaagcttacagtacactgaatcggaagtggcatgataaaggagaacttctatgtcatcttgaaacacaagtaaaagaagtgaaagaaaaatttgaaaacagggaaaagaaacttaaagcggaaagagacaaaggtattgaactacaaaagattgcaatggaaaaacttcatagtatggatgatgcctttaaaagacaagttgatgcaattgttgaagctcatcaagctgaaatagcacagctggccaatgaaaagcagaagtgtattgattctgcaaatttaaaggtccatcaaattgaaaaagaaatgcgtgaacttttggaagaaacatgcaagagc

SEQ ID NO: 26498 - DNA, 444 bp, Homo sapiens
  misc_feature 19, 34: n = A,T,C or G
atccttaacaaatcttttncattttatttctttncatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttttg

SEQ ID NO: 26499 - DNA, 493 bp, Homo sapiens
  misc_feature 15, 39, 471: n = A,T,C or G
cggttactgcggtgnacctctgtctggccggccccttgncactcgcctcggatttgggggcttcctcactcgtggctttccgaagcctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaagctatgtcccagaacactgggaatattataagcatcccatatcaagatggattgcccgtaatttctatgatagtcctgaaaagatatatgaaagaacaatggccgtccttcagattgaagctgaaaaggctgaatacgggaaaggagctggaagtgcgaaaattgatgcatgtgagaggagatgacccctggtnttactatgagacaattgacaag

SEQ ID NO: 26500 - DNA, 494 bp, Homo sapiens
  misc_feature 10, 20: n = A,T,C or G
accacagggnaatcccggcnttatggaccggggaactaatcctgtgggagcagtttattccagtatcacccagggtgcagccacaccaggactgtgttgaagggtgtttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgcccctattattcctggctttgtgctctgccaaacccttctttagcccttcacacatcgcactgaagaatatgatgctgaaggatatggaagacacagatgatgatgatgatgatgatgatgatgatgatgatgatgatgatgaggacaactctctttttccaacaagagagccaagaagccatttttttccatttgatctgtttccaatgtgtc

SEQ ID NO: 26501 - DNA, 399 bp, Homo sapiens
  misc_feature 6, 10, 82, 150: n = A,T,C or G
taatcncggntttatggccgagtgcttctaagaacaagcatctcctgccctctctccttcctccccatctctcgcacgcagncttagagatggactgagccttgcttctcactggcagtgttgagctttggagatgggatggttgctatncaaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcactttttttttctaagaaaataaacattttactgtttttccg

SEQ ID NO: 26502 - DNA, 339 bp, Homo sapiens
  misc_feature 208: n = A,T,C or G
cgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagnatcaaattaaacagacagaaaccgaaagctctatataaatgctcagagttctttatgtatttcttattggcattcaacatatgtaaaatcagaaaacagggaaattttcattaaaaatattggtttgaaat

SEQ ID NO: 26503 - DNA, 286 bp, Homo sapiens
  misc_feature 71: n = A,T,C or G
gaagaatgagaaattctttaaaagcttcaggttttttttgttgttgttgttaaattcctgcatgatgcatnttgtgcaagggaaacttaatatacttttacacccttaacctttataaagtgactagcttttcccttaacataggaatttttaacctggagcccagatttttgagagtacacacaaaattgtgggtttgtgtgcatgtacatatgtccatttttttctagggagaagatccatagttattagatttgtgaaggatttggtgatccccttctcccat

SEQ ID NO: 26504 - DNA, 465 bp, Homo sapiens
  misc_feature 31, 339, 442: n = A,T,C or G
atagtacattcatagatatccactttttttnacttctacatgtcttacaaaactgttgctttcttagtgagctcccggtgagaattacatccaccccttcccctgcactctgaatcctctttactctgctctacttccctcctgcatatgattgaagattttttaccacaatagataatttacttatttattgtgtttattgcttattgtgagtattttctctgctaaagtataagtacttgcagggtagagattattgtcttgtcttgtttacttacctgatgtatctgaaaacagtgtctgacatataatagatacttaatatatatatttttaagnaaaagaatgttgaactacttattcattaagatctgggagtacttcccacagccctctataattgcccatgggaaggattcttgcaataaattttatcatgtgngggcttataatctggtttggctt

SEQ ID NO: 26505 - DNA, 489 bp, Homo sapiens
  misc_feature 63, 188: n = A,T,C or G
gttctttttccggctggaaccatggagggtgtagaagagaagaagaaggaggttcctgctgtnccagaaacccttaagaaaaagcgaaggaatttcgcagagctgaagatcaagcgcctgagaaagaagtttgcccaaaagatgcttcgaaaggcaaggaggaagcttatctatgaaaaagcaaagcnctatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagctttcttcgccttcgtcaaatcttcaatggaacctttgtgaagctcaacaaggcttcgattaacatgctgaggattgtagagccatatattgcatggggggtaccccaatctgaagtcagtaaatgaactaatctaca

SEQ ID NO: 26506 - DNA, 267 bp, Homo sapiens
  misc_feature 26: n = A,T,C or G
ctgaaatcccaacaaaaaaaatttanctccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatggt

SEQ ID NO: 26507 - DNA, 200 bp, Homo sapiens
gagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaat

SEQ ID NO: 26508 - DNA, 401 bp, Homo sapiens
  misc_feature 3, 28, 51, 99, 103, 122, 136, 172, 178, 205, 249, 361: n = A,T,C or G
acncaggttcttattgtccattgggttnggaagatttacttagctaggagnaacaattcccaaatttgccctagttgcaatatttttttaccaagggtncatncaagtcagggttcactttntgaaagtaaggaancacaggatagcattcacttgatgatcataacacagnctgggnatacattattgtgtttgggtgtatacntttaaaaaaaaggtcgtttatatttggttttggaatcaactttngaatttgtctaaactggttaagaatttacaagttctatttaaagatatctgggccagaaaccagaaccacttgtgtttaaatactattgctattctgtacacagctcaaggntctggtattttctcttaagcattcctcttctccccttcca

SEQ ID NO: 26509 - DNA, 113 bp, Homo sapiens
  misc_feature 2: n = A,T,C or G
gntcttttttccggttagcgcggcgtgagtatgccatgagcagcaaagtctctcgcgacaccctgtacgaggcggtgcgggaagtcctgcacgggaaccagcgcaagcgccga

SEQ ID NO: 26510 - DNA, 403 bp, Homo sapiens
  misc_feature 6, 11, 59, 62: n = A,T,C or G
atggcnggagntaattgagaactacagcttttaagtattgtacttttatcttaaagggnggnagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaaccgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgc

SEQ ID NO: 26511 - DNA, 466 bp, Homo sapiens
gtttctgagcagcgcttcctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaacaacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaac

SEQ ID NO: 26512 - DNA, 148 bp, Homo sapiens
  misc_feature 1, 6, 30, 32, 76, 77, 83, 85: n = A,T,C or G
nattgncattttaacggggataacgctgantntgttgatcagtcttgggtactatggccattagaacagtaacagnnttaagntngctaatcaatgaacacgggatatcttttccatttatttgggcctttaatttctttcatcaaca

SEQ ID NO: 26513 - DNA, 185 bp, Homo sapiens
  misc_feature 162: n = A,T,C or G
gagtagctccgcccgctggtcatcgcgccctttcccctgccggtgtcctgctcgccgtccccgccatgctgtctctagactttttggacgatgtgcggcggatgaacaagcggcagcttctattatcaagtcctaaattttggaatgattgtctcatcggcnctaatgatctggaaggggttaat

SEQ ID NO: 26514 - DNA, 479 bp, Homo sapiens
atgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaaggtaccggtttcctgtgctgcttg

SEQ ID NO: 26515 - DNA, 453 bp, Homo sapiens
  misc_feature 3, 57, 58, 62, 71: n = A,T,C or G
agnaaattctgaaggaatctaagcccggttgctatgaggtgtcgcttgcaagcaagnntgcncttcttggnagcagaatggaatgaaccatccatcaacttctataaaagaagaggtgcttctgatctgtccagtgaagagggttggagactgttcaagatcgacaaggagtacttgctaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcagttgttgcatgtttgaaatgaggtctgtttaaagtggcaatctcagatgcagtttggagagtcagatctttctccttgaatatctttcgataaacaacaaggtggtgtgatcttaatatattttg

SEQ ID NO: 26516 - DNA, 472 bp, Homo sapiens
  misc_feature 6, 31, 32: n = A,T,C or G
gccttncggccggaaccgccatcttccagtnnttcgccaaaatgacgaacacataagggaaagaggagaggcacccgatatatgttctctaggccttttagaaaacatggagttgttcctttggccacatatatgcgaatctataagaaaggtgatattgtagacatcaagggaatgggtacttgttcaaaaaggaatgccccacaagtgttaccatggcaaaactggaagagtctacaatgttacccagcatgctgttggcatttgttgtaaacaaacaagttaagggcaagattcttgccaagagaattaatgtgcgtattgagcacattaagcactctaagagccgagatagcttcctgaaacgtgtgaaggaaaatgatcaggaaaaagaaagaagccaaagagaaaggtacctgggttcaactaaagcgccagccttgctccacccagagaagcacacttttgtgag

SEQ ID NO: 26517 - DNA, 490 bp, Homo sapiens
  misc_feature 26, 32, 34, 54, 101, 169, 178, 187, 292, 356, 391: n = A,T,C or G
gaaatatccaggtctaattaagaagncccatntngtttattttgtaacccaagncttttttagaggtcacgacttcctaatcaaaggcctgggcctgcagncctttcatcttaatgcaacttcctttgaaatcaaagaatattttgtctgagagctctaaggatctggnaatagactncaaaatgtnaagtgaaatttttttttcctctatttatcaatgatatatttcacttttaaaggaaattttagaggaaaattaatagctgctttttgcctaaaaaaccttgtgggnggaaacattcctctgagaatggcttttataggtattttgcctggtaatgtattcattcatgatngcccatattcttgaatgtcttcattccaatggggncaggtcaatattatgaaaataatttttatatttatatttgtaacttaaggaatttatttccccctttactacagcatgtaaattcagctcaaattgcat

SEQ ID NO: 26518 - DNA, 262 bp, Homo sapiens
  misc_feature 2, 240: n = A,T,C or G
gntttctaccgggaattcggcctttggccggggaatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatncatttctgataaagttctctat

SEQ ID NO: 26519 - DNA, 458 bp, Homo sapiens
attttgaaggaatttaatattttaagcaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcat

SEQ ID NO: 26520 - DNA, 332 bp, Homo sapiens
  misc_feature 327, 328, 332: n = A,T,C or G
ggataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggggctnnaagn

SEQ ID NO: 26521 - DNA, 460 bp, Homo sapiens
  misc_feature 9, 12, 16, 22, 25, 63, 76, 376, 460: n = A,T,C or G
gaactcggnggnggcncttgcncancaccaggacttcgctcgtactcgtgcgcctcgcttcgnttttcctccgccnccatgtctgacaaacccgatatggctgagatcgagaaattcgataagtcgaaactgaagaagatagagacgcaagagaaaaatccactgccttccaaagaaacgattgaacgggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcncctgcctttcccatctgtctatctatctggctggcagggaaggaaagaacttgcatgttggtgaaggaagaagtggggtggaan

SEQ ID NO: 26522 - DNA, 472 bp, Homo sapiens
aggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctg

SEQ ID NO: 26523 - DNA, 470 bp, Homo sapiens
ccactatgtttgtgtgtatgtgtgtgtttgtgtgtgtatgtgtggtcttgatgccagcaatgcaaacaccaatatatctattaagaagtgattgaatttagattggaaaaaataaaatagttacatgtaaagacataaactctttccttcttaaatgtgattttcaactctatgatagaaactccctctaaaaaacaagcagggcaagaacaaacttacttgtaatgggtgagagaaaataagcaaatctcattggctcattcctgtttttaggaagttgcagtgggattaatgtcaattggaagggatgcagcaagtttagagaaggtgttggcactaacgctgcttgtttggcaaatcatcactgaggtattccacccagagactttttcaaaaaagtcaactaaagtgctaagtcataagaggagagccactatacccgttgtctttctgggctccttgagtttatc

SEQ ID NO: 26524 - DNA, 444 bp, Homo sapiens
gggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaac

SEQ ID NO: 26525 - DNA, 423 bp, Homo sapiens
  misc_feature 21, 25: n = A,T,C or G
atttcaccccaaaattttgtncagnaaaagcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtagg

SEQ ID NO: 26526 - DNA, 449 bp, Homo sapiens
  misc_feature 11: n = A,T,C or G
acctataagcnttaagacctaaaatacactgggtgctggaagctatcattgacatactgtcattcaaaaattacatatgtatttggcataaatgtaatagttcatgtacaatgagccatcaagactatgtgcaaatcccaagaactacttcctttttctagttttcttaaagaaataagacataatgaatctattacgagaatctcccacagtgtagcttccccttaataatgtagtatatacatttaaaattacaatgtaatgcttaaaaattgttaacattttacaattttttaaatttagagacttgatctggagagcattgggtgtgattctgcaaatcatgcagcatatattttattacagacttagctgctgaggtttcttacagaggtcaaatgtgtgtgtttatgttctgcttagtcttatgacaaaatatatcactattg

SEQ ID NO: 26527 - DNA, 169 bp, Homo sapiens
ctaaaacaacaacaaaaaatttagatgggtgtggtggcgctcacctgtagtcccagccactcaggaagcagaggcccaaaaaccgcttgaacccaggaggcagaggttgcagtgagccaagatagcgccattgcactccaccctgggtgacagagtgagactctgtctc

SEQ ID NO: 26528 - DNA, 149 bp, Homo sapiens
  misc_feature 2, 12, 20, 23, 53: n = A,T,C or G
anggaaaacctnctggaaantanttcagtacaattctcaagaaaattcactantgtgaatgagatgttttaggagctataaataaattgaatatattggttgctcatttttgaagagagtctctagaatatagattttcacttcttttg

SEQ ID NO: 26529 - DNA, 264 bp, Homo sapiens
  misc_feature 9, 11, 25, 53: n = A,T,C or G
gatgaagancnaaccccatctctantctaccctaagagaactgaaaaacctanaataagttgttctggagccaataaacacagcagctctgttagatgtcctctacagccaagcaatttcaatgctaacttgaactgcatttccttcctcaaatgagagattgacataattcagtactgtgagtcacttgtataagaaacctttgatcactaaaaataatgtaaaaattgggtttagtagcctaatacacataacgttcttctt

SEQ ID NO: 26530 - DNA, 259 bp, Homo sapiens
  misc_feature 23: n = A,T,C or G
gaaaattaagaagccaatcaagnacgaagttcagaatgccagtgtttaactgggttgctctggagcccaatcagatcaatggcacagtcttcgatgaaattgatgatgagcgaattctggaggtatttttctcattggttagaaactagaggtgcactctgtgcagcaaagccggcatgggtgttctgttaacctggaagtgtcagagataaagtactagtgttttaagtcccctgatgtaaagaagaaacatgtatgg

SEQ ID NO: 26531 - DNA, 491 bp, Homo sapiens
  misc_feature 2, 102: n = A,T,C or G
gnttttttcccagggaattcggccttatggccggcgctgtgggaactcatgactctgggccagactccctacgtggacattgaccccttcgagatggccgcntacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttg

SEQ ID NO: 26532 - DNA, 463 bp, Homo sapiens
caatagggatggtaggattcaaatgtgtgtcatttagaagtggaagctattagcaccaatgacataaatacatacaagacacacaactagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttcagggagataattctgcctttaattgtctaaaacaaaaacaaaaccagccaacctatgttacacgtgagattaaaaccaattttttccccattttttctcctttttttctcttgctgcccacattgtgcctttattttatgagccccagttttctgggcttag

SEQ ID NO: 26533 - DNA, 373 bp, Homo sapiens
gggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgttaaatg

SEQ ID NO: 26534 - DNA, 202 bp, Homo sapiens
  misc_feature 8, 16: n = A,T,C or G
ctgaaatnaacctagnatgatttcagttttctctttttggtaatatactaattatagtaatatactaattaaatgttagtggctggccgggcacgatggctcatgcctgtaatgccagcactttgggaggctgacgcaggtggatcacgaggtcaggagttcgagcccagcctggccaatatggtgaaaccccgtctctact

SEQ ID NO: 26535 - DNA, 378 bp, Homo sapiens
gcaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 26536 - DNA, 340 bp, Homo sapiens
  misc_feature 1, 8, 30, 31: n = A,T,C or G
nccggggnataacttaccagtacaccttgnnttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccactacctcccaagaaagaaaatgatgaaatgcccacgtgtctgctgtgtgtttgttt

SEQ ID NO: 26537 - DNA, 468 bp, Homo sapiens
  misc_feature 15: n = A,T,C or G
attaaaattaaattnttctcttattggtgacttatggaaataaagcatcaatattggatgtatttaattcctagtttgttttccattctggaataaaaaggtatttgctgataaaaggcataacgagacatagtgctgctaccactgaataagtgatactttggaaagatgcatgccagtggatgccagaggaccaggctaatgacttgtgtgtgctgatgtgtttccatttgtatttaatgtgtgtagaccctcctctgttcatcaatcaaaaagcatttcctaggcagctcctcgcctgtcagtgtgcatatggaaacagggacatctccatcattactggcttagttttgctttcctttgacacagtaaggcaaaggccaagctttcaaaagagtaaaggatactttcacaatttcccttcatatggatatgattccagtcaaaaataaaatgcacaccaaaatg

SEQ ID NO: 26538 - DNA, 221 bp, Homo sapiens
  misc_feature 9, 11, 34, 39, 40, 47, 48, 126: n = A,T,C or G
ctccggccntntattggcccggggcgtagtcttnaggannagaagannccatgctttgtggaatgtacctgagtgtgaaagtaattgtgacaggaagtccaaggaagagggacaggaggtggggtnccttggaggctagagataatattttagaatcctcagcctgttcttgaagtcatggaagaagtaagaagatgagattctcctaggaggaccacata

SEQ ID NO: 26539 - DNA, 161 bp, Homo sapiens
  misc_feature 17, 26, 75, 161: n = A,T,C or G
ctctggcccggggtagncctgtttcnagttttccctcctgttacgttctgaaattttacacttccgtgaatgtanacttgtcttgtaatgttgcataatgttcactttttatagtgtgtcctttattctaaacagtaaagtggttttatttctatcacacn

SEQ ID NO: 26540 - DNA, 425 bp, Homo sapiens
aacagaagatttataagattggccgggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggggggggggtctcaataaaagttattttcca

SEQ ID NO: 26541 - DNA, 110 bp, Homo sapiens
  misc_feature 4: n = A,T,C or G
cacncctgtaatccagcactttgggaggctgaggtgggcggatcacctgaggtcaggagtttgataccagcctggccaacatggcaaaaccccgtctctactaaaaatac

SEQ ID NO: 26542 - DNA, 194 bp, Homo sapiens
atgtctaaaacaccaaagcatggcaacaaaagccaaaattgacaaatgggatctaattaaactaaagagcttctggacagcagaagaaactacgatcagagtgaacaggcaacctacagaatgggagaaaatttttgcagtctactcatcagacaaaggttcatccagaatctacaatgaacttaaacaaactt

SEQ ID NO: 26543 - DNA, 425 bp, Homo sapiens; identical to SEQ ID NO: 24822

SEQ ID NO: 26544 - DNA, 145 bp, Homo sapiens
atctgtaaagtgaatattgaatggtagcttgagtcattcgtacttatcacagaaaagaattgaactcccagtcatacacctgtaactgaaataccaaactgtcttaatggagatgtaatgaagtaagatggtcacatctttaact

SEQ ID NO: 26545 - DNA, 126 bp, Homo sapiens
  misc_feature 7: n = A,T,C or G
attcagnaagtatagcaacactttatcccaagccagcacgtacaacatgtggtagagtatagtaagtgaaatgtatgctgcttatgtacacttagtattcaatttattccaggtgctcttatttac

SEQ ID NO: 26546 - DNA, 472 bp, Homo sapiens
  misc_feature 171, 208, 330: n = A,T,C or G
ggggggttccagttgaaacacaataaagaacataattaactttacaattctttgtgtttttcatttgactgcagggaggagatgaaagaggactgctaagcctcgcattccatcccaattacaagaaaaatggaaagttgtatgtgtcctataccaccaaccaagaacggngggctatcgggcctcatgaccacattcttagggttgnggaatacacagtatccaggtatcactaaaaggcatcgaagcatagaaatttctcatcttattttctcatcatcttttcataagtttttttatttagaagttgcaaataagtaaccataaggnggcaataattaaatcattacctccatcttgctgaaaactccatatgtgtctttaagagaaatggagaacaacaatggttttgacatttttcctcaattatctctcaacttaaaggctaccctctgaaacttggaaaataatg

SEQ ID NO: 26547 - DNA, 135 bp, Homo sapiens
  misc_feature 2, 32, 49, 55: n = A,T,C or G
cnaaagataagtatgtgcatttgaagatatancaattaaaactattcanaaatanaaacagaaaaaagaccaatgaaaccagtaatgtcagtgaagtggggtgaaggaagaaggagcacagacaagaattcatta

SEQ ID NO: 26548 - DNA, 342 bp, Homo sapiens
agaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaagcct

SEQ ID NO: 26549 - DNA, 353 bp, Homo sapiens
  misc_feature 350: n = A,T,C or G
gatggtagaggtcccccaagaagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaacctgtcaggaagcgacaggtccaagtacagtagacactcaaaatgaacccttagatatgaaagagcccgatgaagaaaagagtgaccaacagggagaggcattggactcatcgcagaagaagacaaagaacangga

SEQ ID NO: 26550 - DNA, 471 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagacattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttggaagggcgatcttttaaaaagagattaaacccga

SEQ ID NO: 26551 - DNA, 371 bp, Homo sapiens
ggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtgtttaaacttgacaatcattacactaaaacagatttgataatcttattcacagttgttattgtttacaga

SEQ ID NO: 26552 - DNA, 126 bp, Homo sapiens
  misc_feature 7, 110, 125: n = A,T,C or G
ggttctnggaaaaatatacctgctagggccgggcacggaggtctgtaatcccagcactttgcggaggccaagttgggcagatcacctggagtcatggagttcaagaccancctggcctgaatggng

SEQ ID NO: 26553 - DNA, 470 bp, Homo sapiens
  misc_feature 9: n = A,T,C or G
accgaaatnaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaaatcagcagagttgatgcagctagcctgaaaggactgaataatttggctaagt

SEQ ID NO: 26554 - DNA, 100 bp, Homo sapiens
gattcaaaatatattttaacccaaaataagttaaataatttgtgcatgtttgtgtgtgtatatatgcatgcacttttttttatattaaaattttgaggcg

SEQ ID NO: 26555 - DNA, 471 bp, Homo sapiens
cgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgag

SEQ ID NO: 26556 - DNA, 468 bp, Homo sapiens
  misc_feature 13: n = A,T,C or G
attctttgatttntaacaactttttaatgtctctttttggaaaaataaaacacttttcttgggggaggaggagaatttttctaaggatttttctgaattcctttgggccataggcactgtagcaaatgctgctcttcctgatctttaacacttttaggattgatagtgtcgttctgagccatgtccaggaattactttggcgaggtttccatttcctatttaattaaaatttttttactaattatattacatttcactagaagttaaataacttctcttgaaagtcatccagaagactttaacagccagatatttggtatctgctcagaattatcacttgtgaaaccttcattaaacataattcagccacatgtcacagaaagttctgcatgtataataactttttgtttcaatgctgcattatagtgatctttaaaagacattttaagaggtaatttaggggatttc

SEQ ID NO: 26557 - DNA, 301 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagcagcatgaggaaggaaaagataaaaggtttctaaaacatgacggaggttgagatgaagcttcttcatggagtaaaaaatgtatct

SEQ ID NO: 26558 - DNA, 119 bp, Homo sapiens
  misc_feature 52, 106: n = A,T,C or G
gaggcattgaggcagccagcgcaggggcttctgctgagggggcaggcggagnttgaggaaaccgcagataagtttttttctctttgaaagatagagattaatacanctacttaaaaaat

SEQ ID NO: 26559 - DNA, 180 bp, Homo sapiens
gagaaggttagttttaccctactgatgatgtgttgttgccatggtaatcctgctcagtacgagaggaaccgcaggttcagacatttggtgtatgtgcttggctgaggagccaatggggcgaagctaccatctgtgggattatgactgaacgcctctaagtcagaatcccgcccaggcgga

SEQ ID NO: 26560 - DNA, 259 bp, Homo sapiens
  misc_feature 246, 255: n = A,T,C or G
gatagaagttgagttttaattaaaattcttggcatcctgaagtatgtcacatagtatgtgctccttataaatatgttgatatctcagaagacagcatcccggttttcattttataaagtaccatacttaagaatgctgtaatacttatcttttataacatgtttccttcgctttgcttgtcttttatgtcatcagttttaactgtttacttcatttaacagtttacatgattgaacagggtacttnattaaacanaccg

SEQ ID NO: 26561 - DNA, 134 bp, Homo sapiens
  misc_feature 2, 52, 69: n = A,T,C or G
gnactgcgataggaatcatgtctggacgcggaaaaggcggaaaaggcttggngaagggaggaagctaancgccatcgtaaaggtgctccagggataacatccagggcattacaaaaccggctattcgccgcttg

SEQ ID NO: 26562 - DNA, 410 bp, Homo sapiens
cttaagcagaattcgatttcttgacatcaagagggaaaatctctttctcttgcttctgcatgagtaaatattgtttaaaataaaaattaagaatgaacacatttgctccttaaaagcaaatcatatgagatgagtgcatattaagtgaacaaacttagatgggaggggggactaaccatccctagggggcccacagatttcaatagaaatttccatggagttattatgaaggataacttccctgaggctttagcccctgcatgatggattcaagagctttacttaaaagtcagcctgtactggcttgtagaaagctttcagcctctttttgcaagtcatttttcagcttcctggtaatgaacaaaacaggtctgataattttcaataataatctcaggaaatgtgtggtg

SEQ ID NO: 26563 - DNA, 469 bp, Homo sapiens
cagttacaaaaatagtagaacaagcaacataaaacaatgaaggaaaacctcacttgaaggcccaagtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaaggaggacacttgtatgctagtctatggtcagttgagg

SEQ ID NO: 26564 - DNA, 230 bp, Homo sapiens
  misc_feature 63, 71: n = A,T,C or G
atcgtggtgtgtcaatgccacaaaatcgtgtgtccgtggaacagtcctagccgcgtgtgacangtcttgcnttctgtttgtctcgtggggggaggtggacaggtcctgcggaaaatgtgtcttgtctccatttggataaaaggaaccaaccaacaaacaatgccatcactggaatttcccaccgctttgtgagccgtgtcggtatgacctagtaaactttgtaccattcc

SEQ ID NO: 26565 - DNA, 118 bp, Homo sapiens
  misc_feature 5, 24: n = A,T,C or G
atatncaggactttgtgcgccaanacagtacgtacaacatgtggtagagtatagtaagtgaaatgtatgctgcttatgtacacttagtattcaatttattccaggtgctcttatttac

SEQ ID NO: 26566 - DNA, 239 bp, Homo sapiens
  misc_feature 12, 34, 51, 53, 66, 69, 80, 82, 90, 117, 122, 140, 168, 226: n = A,T,C or G
gagtgactttgncacagctccaagatagttaagntgggatcgagacatgtnancatcatcatggangtntgaagatgccncntttggatnggatgaattccaaattctgcttgctgngcttnttaatattgatatgcttntacacttacacttatgcacaaaatgtanggttataataatgttaacatggacatgatcttctttataattctactttgagtgctgnctccatgttctga

SEQ ID NO: 26567 - DNA, 271 bp, Homo sapiens
  misc_feature 90: n = A,T,C or G
atgtttgacgtggaagaggaagggtaggaggatgcatggatgagtggatgagtggatcgatggatgtattgataaatagatagaaccagncatctgaagcaacttaagaattgtagccttgactccttgagactgtagatttcgatccaggaaacatttatttagcacctgccagatgccagaaatttataccatttaaaactcaggaagtcttttaaatatcaggaaggggagaagcgacatcatgatacatcctatggggattaaaaag

SEQ ID NO: 26568 - DNA, 472 bp, Homo sapiens
ggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcactctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgcta

SEQ ID NO: 26569 - DNA, 386 bp, Homo sapiens
gttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcgcttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaacca

SEQ ID NO: 26570 - DNA, 176 bp, Homo sapiens
  misc_feature 1, 2, 29, 122, 139: n = A,T,C or G
nnccgggtattcggctttatggcgggggnaggagcctctctccctactgctgctacacaagaaccctgagactgacctgcaggacgaaaccatgaagagcctgatccttcttgccatcctgnccgccttagcggggggnacctttgtgttatgaatcacatgaaagcatgggatct

SEQ ID NO: 26571 - DNA, 466 bp, Homo sapiens
  misc_feature 23: n = A,T,C or G
ggttttcatgaataaatattgtnagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaaggatataaactttccacaccttcctgtcgtgacagataaaagcacagaaaggacaacccttgaaatcatgtaacgttggtcatttcaatattttgtacctgttttaaattctgttagtgtatttacttcattgaaatatttttgagggtacctttgtattttgcttttgaccttggttctgtgatttggatgtcaacaacttccctaaaaagcaccagtg

SEQ ID NO: 26572 - DNA, 470 bp, Homo sapiens
  misc_feature 16: n = A,T,C or G
atatctagtttatttntctctactaacattaatagcatttactgtttacctgctacaaagattacaagttattgtttggaaaatatcttaagttctttagagggaattgtaaagaggtgcaactcatggttactacttttggtgtattataggaaatcaaacacaaagtgtaataatcagcattctgtggagaatttattttgtatcaaaagatctagtgtgaatttacttttaatatttcagtagctacattccatccttttcaaactttaagaaagtgtttagaaatatgagtatgtgtttttaactgcaactcatttatcatcttacatgggctttttttcctaataccacatgggctctctgcaacatgacagtaagtcacatgttggaaaagtaatgggtccttaggggatatttatagagtaagaacaaaattatacatatataaaaattaaaaagcaggagct

SEQ ID NO: 26573 - DNA, 472 bp, Homo sapiens
  misc_feature 18: n = A,T,C or G
ggaggcattgaggcagcnagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttggaaggcgatcttttaaaaagagattaaaccgaag

SEQ ID NO: 26574 - DNA, 474 bp, Homo sapiens
agggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaaggtgtagtgcattgaaacaaatgaacaaaaagtagatacttttactatacaagggtgct

SEQ ID NO: 26575 - DNA, 472 bp, Homo sapiens
  misc_feature 428: n = A,T,C or G
gagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttccgacaatgatagcaagaaaaatgaaagacacagacagtgaagaagaaattagagaagcattccgtgtgtttgataaggatggcaatggctatattagtgctgcagaacttcgccatgtgatgacaaaccttggagagaagttaacagatgnaagaagttgatgaaatgatcagggaagcagattttgatggggat

SEQ ID NO: 26576 - DNA, 402 bp, Homo sapiens
  misc_feature 32: n = A,T,C or G
atggtttcattggatataggccttaagaaatnactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctaatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttattc

SEQ ID NO: 26577 - DNA, 225 bp, Homo sapiens
  misc_feature 4, 11, 27, 40, 42, 56, 67, 79, 86, 113, 123, 152, 165, 166,219, 222: n = A,T,C or G
gagnaaagagntaaaacacagtacttntacttgaaatggnanaacttatttatttntttgctaaatntggaattctagngctcatncaaagttaagctattaaatatacgggngatcattagntcctctaccaagtctggaaagaacatctnccggtatccacanntacaccaggttgctaactgtatttgtacatttccctttgcattcgcttttgtnctngct

SEQ ID NO: 26578 - DNA, 472 bp, Homo sapiens
ggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatatt

SEQ ID NO: 26579 - DNA, 308 bp, Homo sapiens
  misc_feature 304, 305: n = A,T,C or G
ggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggtnngat

SEQ ID NO: 26580 - DNA, 473 bp, Homo sapiens
ggaggttgctatcaaacaaattaatttacagaaacagccaaagaaggaactgatcattaacgagattctggtgatgaaagaattgaaaaatcccaacatcgttaactttttggacagttacctggtaggagatgaattgtttgtggtcatggaataccttgctggggggtcactcactgatgtggtaacagaaacgtgcatggatgaagcacagattgctgctgtatgcagagagtgtttacaggcattggagtttttacatgctaatcaagtgatccacagagacatcaaaagtgacaatgtacttttgggaatggaaggatctgttaagctcactgactttggtttctgtgcccagatcacccctgagcagagcaaacgcagtaccatggtcggaacgccatactggatggcaccagaggtggttacacggagagcttatggccctaaagtcgacatatggtctctgggta

SEQ ID NO: 26581 - DNA, 464 bp, Homo sapiens
aatgcccagtatctttattggattcactttgtgtgtgttagtgctctaaagtagcagtattattattaaactgtccccagagtaaccctgtaggcctaaagtactcagttttaagacaaacactacttcccatgcggggtactttccttatggtaaatgtaaacatgtagactgcattcgaggtgacctaaagtagagaggtcatgaactttgagaatgggcttcctttttggttcagtattagtgagagggagagggagatggatggtggggtaggttttctagtctatcattttacatttttcatggagtccctgcttagtgcagtttccattggaatgggtggaagatgataaagctctcttttttatctactaataatgtgattgcaacttaaaatagcaaaacccaactctccctgtccctccaatccctctcctaaaaagttcagtttggaatctcat

SEQ ID NO: 26582 - DNA, 446 bp, Homo sapiens
  misc_feature 10: n = A,T,C or G
cacccagggnaattcggccttatggccgaggattcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatg

SEQ ID NO: 26583 - DNA, 471 bp, Homo sapiens; identical to SEQ ID NO: 24804

SEQ ID NO: 26584 - DNA, 471 bp, Homo sapiens
  misc_feature 12: n = A,T,C or G
gagactttgagnagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattga

SEQ ID NO: 26585 - DNA, 465 bp, Homo sapiens
ggatatttgttacaacgaacaattctgatgtagctaagcaaattttccttcaaaatcctgtaggataaagccttctaaatgtgtttgagtaatcaagaaataactaggacagtcagaaaacctgctaattaacattaggtgagggaatacttgaaaatggatttcatcttaaccagaagttccagatgacatgcatctttattaagagaaacagaagtaaacagtacattaattaaactttcaaatacacgaagaggcttttaaaataccagtaaggaatgaggaataatacaatggattttcataaaaatatcaagcaattaagataagaaataataagattaggctttgaagtttatacatttgcatattgagaaagaatgccactattcaaatatataaatatatcagtgacttttcaaattttaggatctgttttattgactagatagtatctatccaata

SEQ ID NO: 26586 - DNA, 273 bp, Homo sapiens
atttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattccc

SEQ ID NO: 26587 - DNA, 383 bp, Homo sapiens
  misc_feature 40: n = A,T,C or G
ctactaactgaaatgaaaaattccctagttgaacacaagnagcagataagaaatggtagaagaaagattcagtgatcctgaaggtagatcaagagaaagtatccaggacaggtgcagtggctcacacctataatcctagcactttgggaggctgaggcgagtggatcgcttgagcctgggagtttgagaccaaccctggtaacatggagaaaccatgtctctacaagaaataaaaaattagccaggtatggtggtgcacatctgtagtcctaactacttgggacgctgaggtggcaggatcacctgaacctagggaggttgaggctgtggtgaaccaagattgcaccaatgcactccagcctgtgtgacagagcaagactcta

SEQ ID NO: 26588 - DNA, 471 bp, Homo sapiens
  misc_feature 380: n = A,T,C or G
gcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgtgcatatcacttacatttatttgactaaaactggttattcatactgatagtgatgcttacctgggcattgcatcttagagctcattacacattcctggaaaaattaacgctggaatgttcagtggagtttgcaataatcccaaatttccttctgtatatctttccctaatgtacaagggtatnatttatgtgagataggagggaaaccaataaccatgaggaaaaatgcaacctagctttccataaaataatgcattactgtttattctattgt

SEQ ID NO: 26589 - DNA, 468 bp, Homo sapiens
atgatttaaatggatttttgtttttataaaagtatcataaatttagagataaaatggaggggacccagctttctttacaatgtggatctacctcagttaaacagttgggtgctattactaagtctgtcaaattaaattggaaaaagtaaccaaacagtgagatacaactccacatgaaacttgaaattgtaatttccgtttatttaatgatatttttatttatttgtgccttttatgttgaaccccaatgcattgaaaaaattcagtatgaaacagtacatattttatttatattacaggtgggagaaaagtccaattggtcatggaatttgatagacttttccccagccaactgctacagtgtattataatcccgactgcccccctgtgaaaagaaaaaaaaaatgtccaagagcaaatttaacattttacaaacaataaagtccaaactcctctatgcacatattt

SEQ ID NO: 26590 - DNA, 471 bp, Homo sapiens
catctaaactggagtgatgttagcagacccagcttagagtccttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttattt

SEQ ID NO: 26591 - DNA, 472 bp, Homo sapiens
atgcatgtgtgtaaacacatgttgcatcagtgattgttccaggctttgcctacttgctcccaaacatgtgaaaaagaagaggaagattaagtaagtcattcatatattacttatatctgagtgtttgcaatcatataggggagcatagttcccacaaggaccggtttttgtaaacttttgcttctctttcctgtatttaggcattatatagctatggcagtgatcacccacaggtacaaattctgtatcattcattgcctttacttggaggtttacaaatatttttagtctctacttctttttcaaacacaatcttgaaacctcaacatatgaaacgaataaaggaaaattttgttagcataatgtatgttagatttcagcgtgtaatgctgacttataaaatcgagaagaaagaacaatgaagctttgtgatgaacacagaaatttgaaagcagtgttaggagatgacagc

SEQ ID NO: 26592 - DNA, 471 bp, Homo sapiens
atgttaagtacagttaaaaagtaagcattgtagtaaatagtggattctctggtgtgtattttttatctcagtgttgaaaattggaaaagaatggactgaagtctaaaaactggaataatgaaggacactaaatgcctttattgtagatactatgtttgtaagtctatagctaagcaacttaagccaaaaaggtctttcaactgaagctttaatcagcttattttggagatgttctcttcccttatctcatgcgtcatccctaaaataataagatacatgggatcaaatagcccttgccttttcaacacaaatcagttggaaaattatggtttgagtcctgttgctgccatggcttctgtttctcagaaatgagtgtgtatgaacataccaatctatgtaataggctacctttttttgtcttctttggaactttgtacacaaaccaagacaatatcagggtgacaggtgaat

SEQ ID NO: 26593 - DNA, 338 bp, Homo sapiens
  misc_feature 21: n = A,T,C or G
gggatttccagggaaaaagangttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctccca

SEQ ID NO: 26594 - DNA, 208 bp, Homo sapiens
  misc_feature 134, 179, 181: n = A,T,C or G
gattatcaatacataattaaatgttccatattgcaaatagcactttttcaagtattaaaaatactcagtgtatgttttatgttgaaaatcattctacttaagataatattttaaggaagcattcaagttcctgntgactggcttttctcccattacaaaggacagtgaaggtcagcagngnggagtactgtgtccatcacatccactt

SEQ ID NO: 26595 - DNA, 314 bp, Homo sapiens
ataacagcaaatgaaagactcttcctccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagg

SEQ ID NO: 26596 - DNA, 177 bp, Homo sapiens
  misc_feature 175: n = A,T,C or G
gggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtnga

SEQ ID NO: 26597 - DNA, 369 bp, Homo sapiens
gaggcattgaggcagccagcgtaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaga

SEQ ID NO: 26598 - DNA, 434 bp, Homo sapiens
actcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatgggatgttactctcttgcaccaaattatcttgatacattcaaatttgtctggttaaaaaataggtggtaga

SEQ ID NO: 26599 - DNA, 452 bp, Homo sapiens
ataacagacgaggtcaacgatccctcccttacctcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagaga

SEQ ID NO: 26600 - DNA, 470 bp, Homo sapiens
gtctgaggactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcaggagagtgcttattgacatcagcgagaaagaagctgtgaatctgcaacaagatgcctttgtagttattggtaagaga

SEQ ID NO: 26601 - DNA, 486 bp, Homo sapiens
  misc_feature 12, 36: n = A,T,C or G
gtaattcggccntttattggccggggtccggcgtgncctttttcgttggtggtgttcagttgtggcggttgctggtcagtaacagccaagatgctgcggaatctgctggctcttcgtcagattgggcagaggacgataagcactgcttcccgcagccattttaaaaataaagttccggagaagcaaaaactgttccaggaggatgatgaaattccactgtatctaaagggtggggtagcttgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatg

SEQ ID NO: 26602 - DNA, 474 bp, Homo sapiens
  misc_feature 20: n = A,T,C or G
atctatccatttattaattnacaaatatttattaaagtgcctaccatgattatgtgctgtagaaaagacaaggacatttactaggggggattgtgggcccaatcggcatcataagcatgtctgaagcaaaagacaataatcacatccaacggcaccagttcagctcaactttagaattcagcagtaacagtacagatggcctaaagtacatctgtgtgtatctgtacgtgtgcacacacccatgtatatatatttatctatctgtacaaacactacatatgtatacacactatctatgtaaaatataatatatgtataatgcatataaattctaacaagcgtatttgtgttatctttaaaatagaacaattgtatcttgaagtggtaaatgcagagaattggttttattgttgatctgtggatttaatgatttctaggtgaaaaggacgtttaagtgtacaatttcttttctta

SEQ ID NO: 26603 - DNA, 226 bp, Homo sapiens
  misc_feature 13, 40, 43, 44, 47: n = A,T,C or G
taatttccggccnatctattggcgcggggtggctggcgantannccntttcgaacgtctgccctatcaactttcgatggtagtcgcccgtgcctaccatggtgaccacgggtgacggggaatcagggttcgattccggagaagggagcctgagaaacggctaccacatccaaggaaggcagcaggcgcgcaaattaccccactcccgacccggggaggtagtgaca

SEQ ID NO: 26604 - DNA, 277 bp, Homo sapiens
  misc_feature 3, 7, 41, 43, 63, 72, 75, 76, 78, 80, 148, 168, 170, 210: n = A,T,C or G
tgncagnccgccaaaacagtattgtgtgcaaaggggaggcntnggtgtccttggcaggctganttctaggtnggnnangnggtagcctcacttttaatgaacaaatggcctttattaaaaactgagtgactctatatagctgatcagntttttcacctggaagcattngnttctactttgatatgactgtttttcggacagtttatttgntgagagtgtgaccaaaagttacatgtttgcacctttctagttgaaaataaagtgtatattttttcca

SEQ ID NO: 26605 - DNA, 138 bp, Homo sapiens
  misc_feature 26, 27, 32, 67, 71, 81: n = A,T,C or G
ttatggcggggagcctaggtaaattnnataantacatccaaacatgatcatcgttggagccggagtnggcnggagccgagncgctgatccctaaaatggcgagacatgtgttgttcatcattgtcagccacaagtcct

SEQ ID NO: 26606 - DNA, 366 bp, Homo sapiens
  misc_feature 300: n = A,T,C or G
aaggaaagaggaaaatgaacgagaaaagagagagagcgatcaagagaaaggtccaaggaacagagaagtaggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaaacataaaaatgaaagtaaagaaaaatcaaataaacgaagncgaagtggcagtcaaggaagaactgacagtgttgaaaaatcaaaaaaacgggaacatagtcccagc

SEQ ID NO: 26607 - DNA, 471 bp, Homo sapiens
tatggagctttaatttattaatgcaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgactaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtatta

SEQ ID NO: 26608 - DNA, 115 bp, Homo sapiens
  misc_feature 2, 11, 59, 82: n = A,T,C or G
gnaaaacagtngctatggaacctgcatctaccagggtaagactctgggcattctgctgntgaccttgaggaaaaagaaaaangagctcaaaatttgctttgagagctacagggaa

SEQ ID NO: 26609 - DNA, 321 bp, Homo sapiens
  misc_feature 220: n = A,T,C or G
ataatagcaaagctggactaaagcccaaatggattgtctgtggcaatgcagaagctgatagccttaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacngaactctaggtgaaaaatcaggtagggttcaaattaagtagaactgcccttgccggaatagtgatcttcaaaaaacccttgcttttaggggagggaagccg

SEQ ID NO: 26610 - DNA, 412 bp, Homo sapiens
  misc_feature 408, 409, 410: n = A,T,C or G
gagttgacacaaaataaactacgaaagtggctttaacacatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaaggtgtagcccatgaggtggcaagaaatgggctacatttcctaccccagaaaactacgatagcccttatgaaacttnnnga

SEQ ID NO: 26611 - DNA, 133 bp, Homo sapiens
  misc_feature 6, 11: n = A,T,C or G
gtcccngggtnttcggccttatggcgggatttattatacatttagaaagagagagagcatagttttttattagtataaggcaacttaactgattaaaccttcttaggaaaagcaatagttctgaaagatatgc

SEQ ID NO: 26612 - DNA, 474 bp, Homo sapiens
  misc_feature 4: n = A,T,C or G
cagngcaggcatatgagggagcagaatggaccttatttacagaaaattctaatttgatctatctggtggctgccttgaagacatgctactagacacatgtttttatctctcctgactgagaacttgctttatactaagctgctcccaagggagcatggtctaaacattcttctctactgtctaaggcaatggataacaattgggggaaacaatagactagccaaaaaacttggaagcaaagtctagggaataacatgctgtagggaataaggtctttgaaaaggtcctacatgttcttaagattttagaagaacattcacatgtccagggctgtgcacacactcaggaaaaatgcaggcaggccccagtctcttaactctggctggccattaggctacgcataatcaggaagtgaaggcaaaggctgagtagtaaactgcctggttgagtgttgaaggtatcctcccaccccca

SEQ ID NO: 26613 - DNA, 468 bp, Homo sapiens
gcatgaaaggactcgtcggtttgatgtttccattaagctcaatgagtaactctaatagttactcttgaatctggattgaaaaacaccatgcatctgatgagataattcataaatgttgccccttttttaaatgatacaaccctaaaagtgactgaattgcccaagtgcttgaacatggcagaggtagttactcttattttgcagtttgtgcacttaaaaattcctacagtgattgttactttactggggaaaaaagatgaggtgaaacttcctcccaaggaattaaaatatctgtagaagccatggcttgcttttataatgtggaaatcatttgatttgctgtaattcacgcagatccctccttttgtcagggggaaatgatttgcatcatgttctttttttcataatgcttttacttcctgtttggatcagttgtatgtaaatgtacattttttgttactttggctg

SEQ ID NO: 26614 - DNA, 466 bp, Homo sapiens
atgtggaaactttttgcttcgaatattgtgtctttttaaatctaaatgttcatatttttcctgaagaaaccactgtgtaaaaatcaaattttaattttgaatggaataatttcaaagaactatgaagatgatttgaagctctaatttatatagtcacctataaaatgttctttatatgtgttcataagtaaattttatattgattaagttaaacttttgaattgatttgaggagcagtaaaatgaaagctatatctattctaaaccttatttagacattggtaccagttacccaggtgaaaatatggagtaactttgttttgtatggtaaggtttaggaatggtggatgaagggtatctctatataaataaagtgctcaacaatgtgcaatgattgtaaatttagtaagatattacagccatttcatgaatgctttaccattcaacatagtatctattacaaaaca

SEQ ID NO: 26615 - DNA, 468 bp, Homo sapiens
cactttcaaagtcttggatatattctttgaaaaatgagtagtatggaatattaagattatgttccttatactcagaatactttttatgagctctcttgtttttttgttactattattcctttgaaaaaaagacaaaatatctaaaaaatgtttatagtgttcatgtaatttttttttgctgtttaccaatgaactttgccctgttgtggttttgggggatcagaaggattcctaaactgtcatttcatttattggtaggtcatgattgctgagggttttgctttggatttttcatacctataaagtcaatcttgagttgatcagagaaagggaaacttactcctaataaacagactcagaacagaagggacatatgcataaatcaggataccatctcattaatttacaaaggataatctttcttttcattgacaacacctacacccacctgttttccagtgttcttct

SEQ ID NO: 26616 - DNA, 469 bp, Homo sapiens
gggccgtcgttgttgttgtgctcggtgcactgagctccgcggctccgcgagccggttccgtccccttcccgccgccgccatgaagtggatgttcaaggaggaccactcgctggaacacagatgcgtggagtccgcgaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttg

SEQ ID NO: 26617 - DNA, 156 bp, Homo sapiens
gatgctcttttaaaaagatataaaaaagaaaaacgcgccgggcgcggtggctcacacctgtaatcccagcactttgggaggccgaggtgagtggatcgcttgaggtcagaggtttgagaccagcctggccaacatggcaaaaccctgtctctactc

SEQ ID NO: 26618 - DNA, 108 bp, Homo sapiens
  misc_feature 26, 48, 81, 86: n = A,T,C or G
gtttataaactgggaatcaaaaaggntttttcttttaggtgagtgggnaagtattacccttgttttaaatatctaagcaangcctntcaaccctccttttgtgttgtg

SEQ ID NO: 26619 - DNA, 341 bp, Homo sapiens
  misc_feature 2, 21, 31, 34: n = A,T,C or G
tntatccagggtaattcggcncttatggacnggngtgagccgacattgccggcgtcttggcgattcggcccgacgagctccgttttcgctacagcatggtggcctactggagacaggctggactcagctacatccgatactcccagatctgtgcaaaagcagtgagagatgcactggaagacagaattcaaagcaaatgctgagaagacttctggcagcaaccgtaaaaattgtgaaagtaaagaaggaataatctaccctgactaaagcttgaaatgctacatttccaaggtgaagatgtgtgggcacatgttatggcagattgaaaaggatctcattcc

SEQ ID NO: 26620 - DNA, 273 bp, Homo sapiens
  misc_feature 5, 7: n = A,T,C or G
gtatncngggtattcggccttatggcgggagttggaaaacttgtgcccttgtatagtgtccccatggcctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgc

SEQ ID NO: 26621 - DNA, 451 bp, Homo sapiens
  misc_feature 2, 15, 295, 389: n = A,T,C or G
gnttttgtcccgggnattcggccttatggcggggagacatcaaactcatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttnatgcacttaaagaagtatttttagaataagaatttgcatacttacctagtgaaacttttctagaattatttttcactctaagtcatgtatgttnctctttgattatttgcatgttatgtttaataagctactagcaaaataaaacatagcaaatgg

SEQ ID NO: 26622 - DNA, 303 bp, Homo sapiens
  misc_feature 11, 146: n = A,T,C or G
acatgggtcgnttgtgccttccgattttcttgcatttgtttttttcctgacctgaagttgttgttacaaaatcagtcagactttgtgggctgaaggacacggtgcagcagagggtgtccctgtgagagttctgcagagtgctgggnatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaat

SEQ ID NO: 26623 - DNA, 473 bp, Homo sapiens
aagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatg

SEQ ID NO: 26624 - DNA, 467 bp, Homo sapiens
  misc_feature 18: n = A,T,C or G
cacttcaatctattttcnaagcccgtgataacactcttccacaaaaaacagttttcaataaccattatccaaggcctctcaccttttcctcaattaagaacaccggtccacatgcagctcatgtaaatatcagatgctttagacaggaagacaaactccatgatggcacttacttggtgccctagacagaaagggaagtgcaacacataccctgtggtcactatgatgatactacctctttagtaataaattgattaattttttttgtttcttctggaaaactaaattattgctgcatatgtttttccccagatttctggatttggggtgccctttaggaattcctgcctggtcttaactctaacatgctgcttagtcccaggacataaatttcaattctgtgaatattacaatctgtagttacttcagcctgtgaaataattttaaaagagaagttctacacttgt

SEQ ID NO: 26625 - DNA, 440 bp, Homo sapiens
  misc_feature 22, 65, 196, 393, 434, 435: n = A,T,C or G
gatgctgacgacatccaggaanagcatttctcaagaagcttaaaccttgggttgtgctgtgcccnacaaggagacatgatctatgaccccagctggcaccatccgcctccactgataccctattattccaagatggtctttgaaacaggacagtttgacgatgctgaagattgagtgtggagctttctgccttgtnggtgggctgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgnttgtgtcaagaggagttgtgttctttgtaaataaaggttannaagag

SEQ ID NO: 26626 - DNA, 261 bp, Homo sapiens
  misc_feature 231: n = A,T,C or G
aatattaatacacttttaatgtcttcctaactactgtgtaaagataacctttaagtggttggtgattgagatgtatgtgaagagaatttgtcctagtagtggatgaaatttgaatattcaaaaatgagccatagaacagaataaagaaattcaagttaaaagatgaaggaattaaaaggcagaaggagttcaatttaaacagtagaaatagataaaaggttaatacattanacagggcataactgcacttttttgtattca

SEQ ID NO: 26627 - DNA, 100 bp, Homo sapiens
gaggcattgaggcagccagcgcaggggcttctgctgagggggcaggcggagcttgaggaaaccgcagataagtttttttctctttgaaagatagagatta

SEQ ID NO: 26628 - DNA, 467 bp, Homo sapiens
  misc_feature 175, 218, 261, 273, 357: n = A,T,C or G
gataccttataatccctgaatatgtacctatttatagagcttcaaaatacatgagacaaaaattaataaaactgcaaggaaaaatagagaaatccacaattatagtcagagattttgatattcctctcttgagaattgatagaacaatagaaaaaaaaaacagtaaggatatgcncgacttgaacaacactgtcaacttgatctaattgacatttgcncagtaatctcccaaacaacagcagaatacacattttttcaagngcaagaggaatntgtatgataaaacaagtctcagtaaattttagaagattcaagtcatgttgtctgaccacaatggaattaacttagaagtaagtnttataaagatatctgaaaagtactgcattatttggaaatgaaataagacatttctaaatagcccgtaagtcaaagaagtcaaaagggaaattagaaagtattttgaatgg

SEQ ID NO: 26629 - DNA, 349 bp, Homo sapiens
  misc_feature 3, 16: n = A,T,C or G
gcntgaattcacttcngtagagacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatgtccctattgtgacagagccatggtgtgtttgtaataataaaaccaaagaaacat

SEQ ID NO: 26630 - DNA, 465 bp, Homo sapiens
  misc_feature 7, 15, 19: n = A,T,C or G
atttttnaaactgtnattncgaggaattatcagcattgtaatttgtctgggataatgtctttagtttcagaaagttttgtgtttggcatcgttaccactctgttgacatataaatttcctcttgagcttaggaggcttctctgagagtcaaacatttactttgagagtgggcagatcttgctttacttggaaggatacacttacaggatagaaacacagaatacttgaacactgaagaatttgaaaatgtcaattctcagaagatcttgaacacttatctccaaatgtgacacagaaacttactgtaataacccctaaaatctgcttgaattacttagcacaagaaaaaaatgaatgcttgagctggctattttgaattgagtcaatttaagattttaaaattcatatgtagcttagaatcagtacatcttactctttggtttatggcaaatcatggtattgatg

SEQ ID NO: 26631 - DNA, 247 bp, Homo sapiens
  misc_feature 3, 14, 24, 246: n = A,T,C or G
agnggaaaactttnagtgaacagnaaggatggtgtcctactgtggatgagggatgaacaaggggatggctttgatccaatggagcctgggaggtgtgcccagaaagctcgtctgtagcgggttttgtgagagtgaacactttccactttttgacaccttatcctgatgtatggttccaggatttggattttgattttccaaatgtagcttgaaatttcaataaactttgctctgtttttctaaaant

SEQ ID NO: 26632 - DNA, 347 bp, Homo sapiens
gtcgtggtttccaaagttttatttttctcaccaatggaacttttgattcaaataaaatatccaagggatttcagcttataaaacacacaaaattgataatgagttttccaaggtactgtgtgtgaatgtgtatgtctgtgtatgtgtgtgtcgtctgtatgtttttcccacctcttgtagaagctacgaagcacctttccatattattgaggtttcctgtacgtagactgaaatttacaaatcacatgcttacattttatagtaagacaaaatctgccaaagtgtatattgctgttgatataattctgtttgtgattctctctttaaaaataaatccaaaggttttc

SEQ ID NO: 26633 - DNA, 215 bp, Homo sapiens
  misc_feature 8, 76, 100, 110, 130, 147, 182, 184, 212: n = A,T,C or G
ataccagngaagaataaaagggtgaagaataataagggatatgatgacaaggttgatccacttcaagtaattgctngctttcaggaagagagatgtgttncaacaagccnactaaaatatattgctgcanatggaagcttttctgtnctattataaaactgtcgatgtattctgaccaaggngngacaatctcctaaaggaatacactgaangtg

SEQ ID NO: 26634 - DNA, 137 bp, Homo sapiens
  misc_feature 105: n = A,T,C or G
gatcacctgaggttgggagttcgagaccagcctgaccaacatggagaaacctcgtctctactaaaaatacaaaattagccgggtgtggtggcgcactgccttgtnatctcagctatttgggaggctgaggcagggag

SEQ ID NO: 26635 - DNA, 465 bp, Homo sapiens
atatcaggtacatcaggaacgtctctatcaagaatacaatttcagcaaggctgagggccatctgaaacagatggagaagatatatactcagcaaatacaaagcaaggatgtggaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatgggagattttctgttcagaccattttttgcgggttctcccacagcacctgaacccagcaacagct

SEQ ID NO: 26636 - DNA, 470 bp, Homo sapiens
  misc_feature 3: n = A,T,C or G
atngacaagtagcattctcgattggatgctgagcctagtgaagtataaggatcagatcaagaagatgagagagggtcctgcaaagaatatggtcaagcagaaagccttgcgagttttaaagcaaaagaggatgtatgagcagcagcggggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggca

SEQ ID NO: 26637 - DNA, 335 bp, Homo sapiens
  misc_feature 5, 87: n = A,T,C or G
aactntacattttgaaaacacttatctagtctgaactgcagtttgaaagacactgatctagtctgttactgtgctgtctaaaatcangttcattcatttttcaacatccatttgttaaatgcagtatcggttattttgctagtagctgggaatagagtgatgagtaaagcagtcgttatcactggtggcatgaagcatagagtctagtgggatggagcatatgaaccaaaaaaaaacatccaaatgtataaatactctgcatgataaattccgtgggggaaaagagcaaaagcgattaaatggggaacctcatctgactttgggggtgattcagg

SEQ ID NO: 26638 - DNA, 168 bp, Homo sapiens
aagggcaaaatgtacaaacttagaagaaaattggaagatagaaacaagatagaaaatgaaaatattgtcaagagtttcagatagaaaatgaaaaacaagctaagacaagtattggagaaatatagaagatagaaaaatataaagccaaaaattggataaaatagcacc

SEQ ID NO: 26639 - DNA, 128 bp, Homo sapiens
  misc_feature 128: n = A,T,C or G
ctgctgaggcctgtgggtgggacacccagtgcgaaaccctcatccagttttctctccatctcttttctttgtacaatcccatttcctattaccattctctgcaataaactcaaatcacatgtctgcgn

SEQ ID NO: 26640 - DNA, 471 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaag

SEQ ID NO: 26641 - DNA, 470 bp, Homo sapiens
  misc_feature 8: n = A,T,C or G
gggctganggtggtgagactgcgagggacaggtgagagatgaagctcagaagacatctttgcagagatgtggagaagacaggaggaagtccttcctaaaataaacctgacctcctattgctggtatttatgcagctttgaccaggacctggtaacagatgtggatggacttgaaccaccaactcagcttagaaggaagccaagacttaaagtttcctagatcccagcttcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggac

SEQ ID NO: 26642 - DNA, 273 bp, Homo sapiens
gactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccc

SEQ ID NO: 26643 - DNA, 404 bp, Homo sapiens
gtttctgtctcatcggctacaactgagttacgtggccaccccttgctgcagtgaatctaggaaagtgagtagtattgatgacttttctggtattgttttggatcttttcgtttcttcaagtgtaccatcaaaaatcctggtattctggccagacacagtggcttacgcctataagcccaggattttgggaggccaagtcaggcaaatcacttgaggtcaggagttcgagaccagccgggcatgatgatgctcacctgtagtcccagctactcgggaggctgaagcaagataattgcttgaacctgggaggttgcagtgagcagagatcacactgctgtactccagcctgggcaacagagtgagactctgtctcaaaaataataataataataaattctagattc

SEQ ID NO: 26644 - DNA, 470 bp, Homo sapiens
  misc_feature 1: n = A,T,C or G
ntgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattc

SEQ ID NO: 26645 - DNA, 467 bp, Homo sapiens
  misc_feature 12, 14, 22, 47, 250, 433, 454: n = A,T,C or G
gaagaagacagnanacgcaagnagaaaaatccactgccttccaaagnaaacgattgaacaggagaagcaagcaggcgaatcgtaatgaggcgtgcgccgccaatatgcactgtacattccacaagcattaccttcttattttacttcttttagctgtttaactttgtaagatgcaaagaggttggatcaagtttaaatgactgtgctgcccctttcacatcaaagaactactgacaacgaaggccgcgcntgcctttcccatctgtctatctatctggctggcagggaaggaaagaacttgcatgttggtgaaggaagaagtggggtggaagaagtggggtgggccgacagtgaaatctagagtaaaaccaagctggcccaaggtgtcctgcaggctgtaatgcagtttaatcagagtgccattttttttttngtccaaatgatttaaattttnggaatgcccaatt

SEQ ID NO: 26646 - DNA, 497 bp, Homo sapiens
  misc_feature 2, 23, 30, 34, 111, 116, 125, 185, 287: n = A,T,C or G
gnttttttcccgggtattcggcnttatggngggntattcttcccctctctacaaccctctctcctcagcgcttcttctttcttggtttggggcttctgagatgtgggcttnacacncctggttgnttattaatcctgactgctgacttggcgtgccctcttggagaaggccctggatgtgatggngtccacctttccacaagtactcgggcaaagagggtgacaaggttcaagctcaacaagtcagaactaaaggagctgctgacccgggagctgcccagcttcttnggggaaaaggacagatgaagctgctttccagaagctgatgagcaactttggacagcaacaggggacaacgagggggactttccaagagtactgtgtcttcctgtcctgcatcgcattgatgtgtaacgaattctttgaaggcttcccagataagcagcccaggaagaaatgaaaactcctctgatgtggttggggggctgccagcttggg

SEQ ID NO: 26647 - DNA, 119 bp, Homo sapiens
  misc_feature 23, 48, 49, 75, 97, 118: n = A,T,C or G
cattgaggcagccagcgcagggncttctgctgagggggcaggcggagnntgaggaaaccgcagataagttttttnctctttgaaagatagagattantccacctccttaaaaaatttng

SEQ ID NO: 26648 - DNA, 326 bp, Homo sapiens
  misc_feature 12, 17, 27, 30, 65, 73, 109, 121, 125, 221, 243, 257, 289: n = A,T,C or G
ctctggccgggngctgntattgtagancanttcgggagatagagtttgaagtggaaaactggagncagaagtncgggtaggcgaagaaaagaatagagaaggatagggnaattagaagatnaaancatacttttaggagaaaaaagataaatttaaacctgaaaagtaggaagcagaagaaaaaagacaagctaggaaacaaaaagctaagggcaaaatgnacaaacttagaagaaaattggnagatagaaacaagntagaaaatgaaaatattgtcaagagtttcagnatagaaaatgaaaaacaagctaagacaagtattggag

SEQ ID NO: 26649 - DNA, 469 bp, Homo sapiens
  misc_feature 416: n = A,T,C or G
ataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggtgattattttttatactgtatgtgccaaagctttactactgtggaaagac

SEQ ID NO: 26650 - DNA, 464 bp, Homo sapiens
atacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcatattttaaaaagaactgtactgtaaatggaatgcttgacttagcaaaatttgtgctctttcatttgctgttagaaaaacagaattaacaaagacagtaatgtgaagagtgcattacactattcttattctttagtaacttggggtagtactgaatatttttaatcatcttaagtatgatttgatataatcttattggaaataccttatcatgtcttagagcccgtctttatgttt

SEQ ID NO: 26651 - DNA, 155 bp, Homo sapiens
  misc_feature 111, 119: n = A,T,C or G
aatgcttttagtattaaaatgaaggtgacttaaacagcttaaagtttagtttaaaagttgtaggtgattaaaataatttgaaggcgatcttttaaaaagagattaaaccgnaggtgttnaaaagaccttgaaatccatgacgcaggggagaattt

SEQ ID NO: 26652 - DNA, 290 bp, Homo sapiens
  misc_feature 2, 82, 276: n = A,T,C or G
angctgaggtgattaaggaagtccaggagttttacaaggacacctacaacaagctgaaaaccaaggatgagccccagcgggnaaacgctgaaagccatccactatgcgttgaactgctgtggtttggctgggggcgtggaaaagtttatctcagacatctgccccaagaaggacgtactcgaaaccttcaccgtgaagtcctgtcctgatgccatcaaagaggtcttcgacaataaattccacatcatcggcgcagtgggcatcggcatttgccgnggtcatgatatttg

SEQ ID NO: 26653 - DNA, 468 bp, Homo sapiens
atattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagttttt

SEQ ID NO: 26654 - DNA, 100 bp, Homo sapiens
  misc_feature 2, 12, 36, 41, 73, 86, 94: n = A,T,C or G
gnttttgtcccngggtattcggccttatggcggggntgctnaagtttatctttggatagctgatcttgtcttnatagtaaccttgntctaaagncctact

SEQ ID NO: 26655 - DNA, 465 bp, Homo sapiens
  misc_feature 26: n = A,T,C or G
gtgattcagcaagtttcatctcaagnagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacagaagaaactcaaagtaaaagataacaagaagaacagaactaaaaagaaacctac

SEQ ID NO: 26656 - DNA, 299 bp, Homo sapiens
  misc_feature 2, 98: n = A,T,C or G
tntccagggtaattcggccttatggaccgggtagcgccatttttttggaaacctctgcgccatgagagccaagcggaggaagaggcgaatgcgcaggntgaagcgcaaaagaagaaagatgaggcagaggtccaagtaaaccgctagcttgttgcaccgtggaggccacaggagcagaaacatggaatgccagacgctggggatgctggtacaagttgtgggactgcatgctacttgtctagagcttgtctcaatggatctagaacttcatcgccctctgatcgccgatcacctctgag

SEQ ID NO: 26657 - DNA, 496 bp, Homo sapiens
  misc_feature 1: n = A,T,C or G
ngtccacggggtaattcggccttatggcggggggaaaagacaatagaataaataaacaatgaatatagctgacaccacaatgatgctgaatgtatgaggaattgataccaagtaaatctgcattttatgcatgtaccagcgatcatctcaagagagacctctgatttttcacagtttcagcagttgaagtcaagtaaaagacccaagcttcacagaccaggaccctgtgtaatgtcttggaaattgactggggaattcattgggcaccacacacaaagtgactaggcagtcagcttagaactcaagtgcagagaccacatcacacttattccaaaattgaccacatagttggaagtaaagcactcctctgcaaatgtaaaagaacagaaattatagcaaactgtctctcagaccacagggcaatcaaactagaactcaggattaagaaactcgctcaaaaccgctcaactacatggaaactgggcaacctgctcct

SEQ ID NO: 26658 - DNA, 418 bp, Homo sapiens
gatagctgcattcatttatcaccgctattgtgttctgagtgaatccactgtttgtcctgtcggatgcttgcttgattttttggcttcttatttctaagtagatagaaagcaataaaaatactatgaaatgaaagaacttgttcacaggttctgcgttacaacagtaacacatctttaatccgcctaattcttgttgttctgtaggttaaatgcaggtattttaactgtgtgaacgccaaactaaagtttacagtctttctttctgaattttgagtatcttctgttgtagaataataataaaaagactattaagagcaataaattatttttaagaaatcgagatttagtaaatcctattatgtgttcaaggaccacatgtgttctctattttgcctttaaatttttgtgaaccaatttt

SEQ ID NO: 26659 - DNA, 472 bp, Homo sapiens
atgaaaacctagcatcatgttgcaattaaatcttactgggaaaaatatgctacagtttacaatgccagttaaagatagatttattgcttactctgataatgtctttggtgggcaaaatacccctctgaaaagatatacacattgtaatccctgcaaccttaaatgtgttatattatataacaagggagaaataaagttgtagatgaaattaaggttgctaatcagttgaccttaaataaacagattatcttggattatcctgatgtgcccaatgtaatcacaagccccctcaaatgggaaagaagaaggcagagagttgttatcttgagaaagactagatttaccattgctggctttaaacactgaaggggaccgtgagctgagaatttgggcagattctagaagctagaaaaggcaagaaaatgaattcttcccaagaacttccagaaaagaatacaaccctgccaacatc

SEQ ID NO: 26660 - DNA, 341 bp, Homo sapiens
gcattgactatgggagaaaaattagggggaaatgaccgtcatggtgtttttttttaattttaaggactgaaattctgttacatgatgtatgacaatataaaaacatacttagttttatactaaatctttttttaaggtcttggcatttaatataaagcaaattcacacgttttctaactttccataagttccaaaaagggaaagaagaaacctcagtcttgaaatttggatttttaaaaatcatgacactgttttaccatgaaattgagtagctaacttttggtaacaccttttgtttctttgtatgtttgtaataatggacattttaaaacacaggaatg

SEQ ID NO: 26661 - DNA, 428 bp, Homo sapiens
ggacagaagggattattgcttctgaagaagaaaaaaaatgattacaaactgtcctcacactgtcacccaggctggagtgcactggcgcgatctcggctcactgcaacctctgcctcctgggttcaagcgattctcctgccttagccgtgatgttcagtttctaatactaatcacctattttaccgtcttttacaacttcgttgtaggaggtgtgaaagaggagggaaattgtgttggaagaggagattaggacatcaagagacaccaagagtaaccatgtacagagaaaaacatcatatgaagacacagcaagaaggtggccatctgtaagccaaagagaggcctcagaagaaaccaaatctgctaacacaatcatggactttcagcctccaggactgtgtgaaaataaatttctgctgtttaagcca

SEQ ID NO: 26662 - DNA, 442 bp, Homo sapiens
gaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagataggaagtttggaagtggaaaactggaagacagaagtacgggaaggcgaagaaaagaataga

SEQ ID NO: 26663 - DNA, 170 bp, Homo sapiens
catcaaataacaaccaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttcc

SEQ ID NO: 26664 - DNA, 447 bp, Homo sapiens
ggggcggacgggagcgagtatgtccgctctgactcggctggcgtctttcgctcgcgttggaggccgccttttcagaagcggctgcgcacggactgctggagatggtggagtccgtcatgccggtggtggtgtgcacatttgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagattg

SEQ ID NO: 26665 - DNA, 301 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatgttgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtattt

SEQ ID NO: 26666 - DNA, 473 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatat

SEQ ID NO: 26667 - DNA, 447 bp, Homo sapiens
gagagcggaggtggcggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagtttaga

SEQ ID NO: 26668 - DNA, 372 bp, Homo sapiens
atatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgatttttttt

SEQ ID NO: 26669 - DNA, 460 bp, Homo sapiens
  misc_feature 279, 304, 406, 415, 432: n = A,T,C or G
atacattttgaaaattaactgggcatggtggcacttgcctataatcctagctacctggaggctgaggcggaaggagtgcctgaggccaggagttcgaggctgcagtgagccatgatcatgccactgctctccagtcttgtgtgttaccttaagtctcagttttcccgtctgtgaaattcaaataatattgcctcataggattgacataagaaatgaagaacagttaccccttcctagaacagtgtcttgaatgtaataaacatcatataaatgttaggntatgtttatttaatttcttatctgncaagtgctaatgaaaaagattattctttaacgtagtaaataataaagcaaatggcttattaaagcttttgagttttgcctttggaaagattctagtattagnattggctgngttttcaactctaaaanatttctgtaattaaagcctgtctgcttt

SEQ ID NO: 26670 - DNA, 362 bp, Homo sapiens
  misc_feature 61, 159, 213: n = A,T,C or G
agtagcgaaaagcttagatgagtacggatacctcttttgaaactcagcctagtaaggaagngaaaacttagcagtcagtgacttggggaaatagttatagaaaatgtcactgaattttttcatatttataattagtcatttacatatttttgtcttgtngatcattacctgtaaatgaaagaccttaataggaaaaaaagagtaaagctcagngtgaatgcaaacatccacaaaatatgatcttcgtttatattctgtgatgttgtttataaatgaatgcctcagttctctgctacccttttcacagctttgtactgtttgccttatattctatttgtgcttttaaagtgggtctgttggga

SEQ ID NO: 26671 - DNA, 482 bp, Homo sapiens
  misc_feature 6, 17, 31, 149: n = A,T,C or G
attacnaaatggacggngccagtaatgtaanatgcattaatagcagatggacaggaaggccaacatgcagagacacctcctgtgtgaatccgcccacagtacaaaatgcttatatagtgtcgagacagatgagtaaatatccatctggngagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagctttcatcagttgagtaccaatgccagaacttgtatcaacttgagggtaacaagcgaataacatgtagaaatggacagccaaacagaagctttattcgagaacaggtgaatcagttgaatttgtgtgtaaacggggatatcgtctttcatca

SEQ ID NO: 26672 - DNA, 345 bp, Homo sapiens
agtgagattactgtgtatggccaatccagataaataagacgatcaagtctttatgaaaaggaaagaaaaatttggaatgcacatctctgtccagctcaattcctcactccttttttaagatggagagctgttaggtttgtctacacagtaggaaacacctgattaaataacagcatggagccaatcttgacaaagaaattggctgcatccaatagaatcccagggccggtcgtggtggctcatgcctgtaatcccaacactttgggcggccgaggtgggaggatcacttgagctttggtctcagggctttgagaccagcctggacagcatagtgagacctcgtct

SEQ ID NO: 26673 - DNA, 340 bp, Homo sapiens
  misc_feature 1, 6, 56, 337: n = A,T,C or G
ngctanaagcaggaactatattattaacaatcttggctttactgtagtttaaggcnggtgatgatgatgcttattagtccacctgaaagaagtccttccaggtttttggaagctttattcctgcttattaccttgcccttgagaagtccttcatggaaagtggaaacactgggttgacttcttttccccatatcctagttgaaagggacagcttatatgtatgttagactgtccaaaagtgtttgtagaacctcattttaaaaaatcaactgtattgtactttttaaaaaatgggatcttaaactctttattaaaaataataaatggaaatgtgttnggc

SEQ ID NO: 26674 - DNA, 468 bp, Homo sapiens
gttgaaaaactgtggactactcagcagaccagtagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttcccgacagttcctg

SEQ ID NO: 26675 - DNA, 248 bp, Homo sapiens
cagctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgc

SEQ ID NO: 26676 - DNA, 468 bp, Homo sapiens
gtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatgactgccttttcattttcatcttttcttgctgctacccatctatgtatgtagtcattggggggaaaatgtagccacattttttatgggaagactt

SEQ ID NO: 26677 - DNA, 345 bp, Homo sapiens
gcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 26678 - DNA, 129 bp, Homo sapiens
  misc_feature 9, 21, 129: n = A,T,C or G
gggacccgnacacagtgattnacacctgtaaattccagcactttgggaggccaaggtaaggcagatcgtttgggcccagaagaattcgagaccagcctgggcagcatggtgagaccccatctctacaan

SEQ ID NO: 26679 - DNA, 276 bp, Homo sapiens
  misc_feature 16, 31: n = A,T,C or G
taactgagctactagnagatattcttatttnctaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttg

SEQ ID NO: 26680 - DNA, 298 bp, Homo sapiens
  misc_feature 8: n = A,T,C or G
attatagnaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattcccttta

SEQ ID NO: 26681 - DNA, 404 bp, Homo sapiens
  misc_feature 3: n = A,T,C or G
ggnatcctctccatgtggcagacagagcaaagcccaacgctttctctgctggattaaagacggcccacagaccagaacttccactatactacttaaaattacataggtggcttgtcaaattcaattgattagtattgtaaaaggaaaaagaagttccttcttacagcttggattcaacggtccaaaacaaaaatgcagctgccattaaagtcacagatgaacaaacttctacactgatttttaaaatcaagaataagggcagcaagtttctggattcactgaatcaacagacacaaaaagacatcattttacaacctcatttcaaaatgaagacttttacctggaccctaggtgtgctattcttcctactagtggacactggacattgcagaggtggacaattt

SEQ ID NO: 26682 - DNA, 274 bp, Homo sapiens
  misc_feature 28: n = A,T,C or G
gagcctggaaacatacagcctctcaagnattgaaccaggaagaaattgaatccctggacagaccaatagtgggatctgaaactgaatcagtaacaaaaagcctaggaaccagagaaagcccaggaccagatgcattcacagccaaattctgtcagaggtataaagagctggtaccattcctacggaaactattccaaaaaaactgagttgggggactcctccctaactcattctgtgaggccagcatcattctgacactaaaacctgtcagaga

SEQ ID NO: 26683 - DNA, 346 bp, Homo sapiens
cagtgacaaaagtaatgattttaatttatggagtagtttcttcccaagtaactgaaaacatgctaaaatctggtcttttagcatctgaagtattttctggaaacaaattgagcctatctggaacctctgttaacatttttcaggccagcaagacactgcttcctttttttgtgtgtgcaatcaacaaaacctgatggaggatactttggcagaagggggttctggaaaaacaaataggctcatataaaaattagggatagcttggggaagaagagggaaagagagagaacaggaaacagcacagagtaaacctttgaaagatacagattggactaattatatattt

SEQ ID NO: 26684 - DNA, 470 bp, Homo sapiens
  misc_feature 6, 7, 32: n = A,T,C or G
ggtgcnntggagtagaagcaggaggttttctncctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaat

SEQ ID NO: 26685 - DNA, 384 bp, Homo sapiens
gggaaatggtagatgcaaaacctcttgtgacactcttactaaactcttgaatttggaattcaaggcccacttcctagtgtcagtttatcacttcaatcttctcaactattattctcctttttatcccatttagtttagtgatataaaatatttcctatcataaatataccttgttacatttctttgtctgtcttaacaaatcttgctgtcaaagtcctgtataaggtctgactcttgtgcatatatgaagatagttgagagcagtgggtagcattgtggttaagagagacccgtagcagaggggccagtttgggacattattgcaagagtctgggcaaaagataaggtcctgtgtctttgactttgtagtcaacagaaaattta

SEQ ID NO: 26686 - DNA, 394 bp, Homo sapiens
  misc_feature 2, 3, 31, 85: n = A,T,C or G
gnnagccgcgtgttgtgctgtggggaaggtngaaggatttgtaaaccccggagcgaggttctgcttacccgaggccgctgctgtncggagacccccgggtgaagccaccgtcatcatgtctgaccaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttatttttttttcttttccctcaatccttttttattttt

SEQ ID NO: 26687 - DNA, 325 bp, Homo sapiens
  misc_feature 16: n = A,T,C or G
ggaccttaagacgagnattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtattt

SEQ ID NO: 26688 - DNA, 369 bp, Homo sapiens
  misc_feature 27, 368, 369: n = A,T,C or G
aatcccaccagcctctccaagggtggngacctatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgagtggggcactcctttcttgcactattccacagggataccttaattctttgtttcctctttacctgttcaaaattccatttacttgatcattctcagtatccactgtctatgtacaataaaggatgtttattnn

SEQ ID NO: 26689 - DNA, 420 bp, Homo sapiens
  misc_feature 5, 9, 25, 28, 35, 176, 190, 208, 232, 245: n = A,T,C or G
tgctnacantaggctgagaaggccncanaataganaactctcccacacccttctgtgttggagataaatttttcgtacctctgcagagactccttgcgtatcccaagttgaaccgcttatgtgctaatgaagagatgatgagatcagtcattgctgactcaattcctctgagcagngatggttctgcagnggtggctcgacctgcgtnattattttgatgaacagtttgagntttgaaccatgtntatttcctgaaatttcagggtctcagcgatagttgtgctcacttagaatttagttttttttgtgtaatcctaattcaagtaatgtttttaaagtttcactgcaaaagtctatgttccaagccattggacagacctgcttgagatatggccagactgcagtgagccctgagaaaga

SEQ ID NO: 26690 - DNA, 494 bp, Homo sapiens
  misc_feature 26, 40, 83, 119, 153, 178, 192, 475: n = A,T,C or G
ctcttggcccgggtacccggtttttnatggcgggcccaanccttttgaaagaagagccaaaaattgcccaatgcgggcatagnaagatgaaaaagcaattcaggggaactttgaaaagnggctttttcatcagattgtgagagaacaattggncattcataagcaacaacaataacancaaaaattaaactngacctacatctcacacctttgtataaaaattaatgcaaaatgaacatgtaaatttaaactaaaaatcttttagaaaaaattagaacactttcagaatctaggactaagcaaagaattgttgacttgacaccaaaagcaaaattcattaaaggaaaaaattgattaattgaacttcatcaaaattaaaaattttgcactgtgaaagatcttgttaagagaatgaaaacacaagctacagacttggagagagtatttgcaaaccagatatatgaagacctagggnctatctctctatcttccat

SEQ ID NO: 26691 - DNA, 170 bp, Homo sapiens
cgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggatcgacaaaagaacc

SEQ ID NO: 26692 - DNA, 243 bp, Homo sapiens
gatatgctgccctgggacccaactggtaagattggccctaagaagcccctgcctgaccacgtgagcattgtggaaccccaaagatgagatactgcccaccacccccatctcagaacagaagggtgggaagccaagagccgcctgccatgccccagccagtccccacagcataacagggtctccttggcagctgtattctggagtctggatgttgctctctaaagacctttaataaaattttgt

SEQ ID NO: 26693 - DNA, 323 bp, Homo sapiens
  misc_feature 4, 24: n = A,T,C or G
aacnttagaggtggggagcaaagnaattctcttatccaacatcaacatcttggttagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttg

SEQ ID NO: 26694 - DNA, 467 bp, Homo sapiens
  misc_feature 28: n = A,T,C or G
gatggacaggaaggccaacatgcagagnacacctcctgtgtgaatccgcccacagtacaaaatgcttatatagtgtcgagacagatgagtaaatatccatctggtgagagagtacgttatcaatgtaggagctcttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattc

SEQ ID NO: 26695 - DNA, 471 bp, Homo sapiens
gagtccgagtggagagagcgagctgagtggttgtgtggtcgcgtctcggaaaccggtagcgcttgcagcatggctgaccaactgactgaagagcggattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgat

SEQ ID NO: 26696 - DNA, 314 bp, Homo sapiens
gactgaaaggagctatttctgccggggccctgacctgcagctgatgagggtctcacagctcccattcacgtcccttcttctttgaatcagggcaccgtctctaacaggccccttttattttagttataatgttcggttttgcaattaaaaattatttttaatgggcatcaggatatttccttctgtctttgaatatgccttttgtttctaatttgtgcaactataacttcacgtgaacctcatggattctggcttaggcaagtggcttctatgtaattagcagtgattccatcttaataaggtcctgtgatctg

SEQ ID NO: 26697 - DNA, 107 bp, Homo sapiens
gggtcactactgcttcatatttttttgtactttcgaaagagaaagatttaaagtagaattaaagactaaaagtgtttagctaagtccctgatgacaagtcttgagta

SEQ ID NO: 26698 - DNA, 335 bp, Homo sapiens
  misc_feature 27, 33, 333: n = A,T,C or G
aaggaagcaggaaaaaaggaagtaagnaaagcntattaaaagtaaagaaaagtagggaagaggaagaagaacgaagaaaagaggaaagaaggaggaggagaagaagaagaacaaggagaagaagaaagaagaagggagaaggagaagaaaagaaggagaagaggaaaaggaagaaggagaaagaaaaggagaaggaagaggaagaagaaggagaaagaaggaagaagaagaagaacaaggagaagaagaaagaagaagggagaaggagaagaaaagaaggagaagaggaaaaggaagaaggagaaagaaaaggagaaggaagaggaagaagangc

SEQ ID NO: 26699 - DNA, 308 bp, Homo sapiens
  misc_feature 32: n = A,T,C or G
atgtgtataagaaatattgcagcctggtcagntgcagtggctcacgcctgtaatcccagcactttgggaggccaaagcaggtggatcgcctgaggtcaggggtttgagaccacgctggctaacctggtgaaaccctgtctctactaaaactacaaaaattagctgggcatggtggcgggcaccttgtaatcccagttactcgggaggctgaggcaggagaatcgcttgaaccagggatgcagaggttgcagtgagccgagatcacaccattgcactccagcatgagtgagacagtgagactccgtctc

SEQ ID NO: 26700 - DNA, 471 bp, Homo sapiens
  misc_feature 32, 378, 456: n = A,T,C or G
gtgactggctgattaccaagttctttgaagcntgtgtttatgctgagctgggaatattcatttattgcttcactcaaccaagatgtattgagtgatactctgtgcagggcactttattaagccttgtgttagaaaaacaatgtatgagagctagttctagtttctaagagctaaaatgtaggaagcagctaggaattataagcaaattgtctggatttccctgagggaccttctctgaatttccctgagggaacttgggttggatcaatagaggtcagtccaaaagacagcatctgaaagcttaactcaaacacaggtccttgaaggtaggccgaggcatgcagcagtttcaaatgaggaggctaaaaggcaaagccnggaacaagacagcaagacagaaaacccatgaggctgacccacacatctggagtcttcctttctgtgcctgtgggagangttttctggtcagct

SEQ ID NO: 26701 - DNA, 381 bp, Homo sapiens
  misc_feature 32: n = A,T,C or G
gaagatgcaaatgttttgaaatgatatgaccnaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccat

SEQ ID NO: 26702 - DNA, 234 bp, Homo sapiens
  misc_feature 12, 26, 118, 177, 203, 204: n = A,T,C or G
tacataaaaatncttatgggaccagnggtggcactttgggaggcactttggggacgcctgatcaacatagatgagaccccatctctacaaaaaatttaaaaactagctgggcactggnggctactcaaaacgctgaagtggaaggatcgcttgagcccaggagttcaaggctgcagngagctatgattgtgccactgccctgnngcctgggtgacagagcaagactctgtctct

SEQ ID NO: 26703 - DNA, 344 bp, Homo sapiens
gattgctgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttgaaat

SEQ ID NO: 26704 - DNA, 466 bp, Homo sapiens
  misc_feature 31: n = A,T,C or G
ggacaactcggtggtggccactgcgcagacnagtacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacggttgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagt

SEQ ID NO: 26705 - DNA, 212 bp, Homo sapiens
  misc_feature 6, 195: n = A,T,C or G
gaagcntttactttgaaaaaattagagtgtttaagcaggcccgagccgcctggataccgcagctaggaataatggaataggaccgcggttctattttgttggttttcggaactgaggccatgattaagagggacggccggggggctttcgtattgcgccgttagaggtgaaattcttggaccggcgcaagacggnccagagcgaaagctttt

SEQ ID NO: 26706 - DNA, 471 bp, Homo sapiens
gagtaaatgttcagtcaaatatttctgaaaggagagatttaaaaacaaggaggtgatttctaaatatgatcaatttgatggatctttgttaaaagtttgtttcaccaacaaataacacctcgttctgcctgtgatcaatatagaaaggtcttcattcattcatcattgcttaatcaatgtcaaggaatagataatttgggaaaatatcacacacataataaaactttgacagcctttaggcaggagtataccctaaataattaccagtatatttgtgttgcagagaaaaatcagtacaataaatctgatacaacattaagccaaggcataagccccagaagacatcagaaaactcattttctacataaccattgcaaacgtaaaaaatgtgagaaagcctttcatgaatgcaccaaccatgtccatcagagtatctttattcaagagaagtctgccaaatgtaataagtgt

SEQ ID NO: 26707 - DNA, 421 bp, Homo sapiens
aattataaccaagctaatatagcaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 26708 - DNA, 373 bp, Homo sapiens
  misc_feature 113: n = A,T,C or G
ctatctgattcatgagccatggttattactgatcgcattgaaaacattgatcacctgggtttctttatttatcgactgtgtcatgacaaggaaacttacaaactgcaacgcanagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattacctt

SEQ ID NO: 26709 - DNA, 472 bp, Homo sapiens
  misc_feature 9, 10, 22, 36, 47, 49, 54, 59, 79: n = A,T,C or G
aagggaaannatgtggaaactntgcaaagaacacangtattgtggantngatgncttgngaaagcagtagaggctttgngactagttcacctttaataaaagcatgttgtggaagaggaagatacactagactgccactaagtatgtgttaacataatagctaatgattcactatgtactagatactgtaatacatgccttatgtattatattactcaattgacacaataatactgtttgccactgagaaaatggaggcttaacagaggttaaacaacttgcccaaggcatcacaataagtagcctagccaagattctaatctaattaacagaaaacacttatatagtgtttactgtatgttagacactattctaaggctctagatacctcaatccattgaattcttacaatagcccattgaggtaggtaatattattcccttttatagatcacaaaagtgaagcatggaga

SEQ ID NO: 26710 - DNA, 307 bp, Homo sapiens
aatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagt

SEQ ID NO: 26711 - DNA, 471 bp, Homo sapiens
  misc_feature 467: n = A,T,C or G
ggttttatcacctgttcagatgagaagatttttgtcttttgtagcactgataaccaggagaagccattaaaagccactggttattttatttttcatcaggcaattttcaaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggntgca

SEQ ID NO: 26712 - DNA, 221 bp, Homo sapiens
aatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgattaaacctcactgaaacccg

SEQ ID NO: 26713 - DNA, 470 bp, Homo sapiens
ggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaata

SEQ ID NO: 26714 - DNA, 214 bp, Homo sapiens
gttattgaaactctagaagtcaaccgggcatggtggctatgcctataatcccagcattttgggatgccaaggcgggtggatcacctgaggtcaggagttcaagaccagtctggccaacatggcgaaaccccgtctctaatacaaatacaaaaattagccaagcatggtggtcacttgtactccagcctgggtgacagagcaagactccgtctcg

SEQ ID NO: 26715 - DNA, 409 bp, Homo sapiens
  misc_feature 11, 342, 357, 375: n = A,T,C or G
aaggaaacagnaggacttgcacaacactgtagacccaatggacctaacagatatgcagagctttctacccaacagcagcagaatacactttcctctcaagcacatggaatattctccaggacagatcacatgtgaggtcacaaaacaagtcctaacaaatttaagaggattaaaataatattgtgtatatttttccaatcataatggaatgaaactagaaatcaacatcagaaggaaaactgagaatatgtgaaaattaaacaacattctctcaaaaaaccaatgggtcaaagaaaaaaaaaagagaaaatttaaaatcttgagataaatgaaaacatgatntaccaaaacttaggngatgcagcaaaagcagtntaaacagggaagtttatagaattaaatgtctacg

SEQ ID NO: 26716 - DNA, 422 bp, Homo sapiens
acacaggttaggagacgtcgctttgaacgtgctataggaccttctcaaacacacaccatcagaatccaatattcaccagccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaacctaatgaagaaatgaataataaattttgacactgaaaaacattttattaataaagaatattgacatgagt

SEQ ID NO: 26717 - DNA, 472 bp, Homo sapiens
  misc_feature 1, 2, 6, 8, 363, 375: n = A,T,C or G
nncagnanagttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttngttaccaaaagnggttctacaaatgctactgaaaaaaatctggaaattcctaatgtcctgagtattaataataaagtttaaaaatgcttttatatcaaaggtgcatcgg

SEQ ID NO: 26718 - DNA, 457 bp, Homo sapiens
  misc_feature 452: n = A,T,C or G
aattaaaaacaactaaaactgaatagcaaatagtttattggtaagtacacggtttcaacgggagtaataaattcacatgaaaaggagacaataatcaagtcaaaagaataaatgcttactaatcatcagaaaatctgtggccattagggctggcacgtaaaaatccaaaatcactcagaggccaaatctgtaaaatcaaaatgaggttgaagacaattagtgaaagtaatgttatagtatcatcatattcccttttgctatctgtcccttttctctatgccagataaacactttctccttactcatcaatcaagaataaaattttctacatcaaagtaagacttgagaaaataaacttatgtgtatatatgtttaaactccaaagtttgggacattcaaacaatgtacatgaaattatatgtgtgtggtgtgtgaataaatatgtatgaatntaagg

SEQ ID NO: 26719 - DNA, 463 bp, Homo sapiens
  misc_feature 444: n = A,T,C or G
ggtccggccacagcctaacgctcttcgctgtcgtttgtggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcnccattcaggaagattacct

SEQ ID NO: 26720 - DNA, 470 bp, Homo sapiens
gtgtctagagaaaaattgcctacctgctgcttaagaacgaaacaaagtaaaacaaaatgtagaaaatactgtgatttatcttaatacttactgtacagattcagtttctctttgttgtagccgagtaagcagtgctagttgaggaatcatgagatcatgctctctagtcttggctcggccagtagctaactttaagtccatgggcaagttattacctccctctctttgtgccttggtagcttgctcttcaaaccaggaagctgagatgatttccaaggtcctttcccttctaaaatgtcaagattctatatgagtttctctttaatatggcataggttatttccgtggtatatattgtacatatttatattaatttcctttaattttagatacgatgaatggattaaagcagataaaatagtaagacctgctgataaaaatgtgccaaagataaaacatcggaagaaaat

SEQ ID NO: 26721 - DNA, 477 bp, Homo sapiens
  misc_feature 7, 23, 41, 91, 407, 461, 475: n = A,T,C or G
attttgncccggggtacccggtntttatggcggggaattangaaaaatattggggaggagactcttgacgggtttctgaaaaaataagagncgacgtagaaatcagttgtcatacccactattaataattaaaggtgaatactttgtatgttttcatttttagtattattcctttattttagaaaatactaaatatttattggggctttcaaatttcacttcccaaattattttcatcctgtttttattataaacttttaaatttaattgtgataaagtttccaatcctgatttttttagtaacttaatattcctgttgaagatggactacttgagtcacgtttgataaaaataaaacaatctaaagacataattactaaaaaaaaaagtaattttgcatataaggngttaagccagtaaaatcaaggactctttatatttataggaatgtcttgtctagngggctaacttggcntg

SEQ ID NO: 26722 - DNA, 119 bp, Homo sapiens
  misc_feature 48, 49, 56, 62, 74, 110, 118: n = A,T,C or G
taagaatggagcttaaccttgcctccattgggaaagtctagactttgnngccaggnacaggnaaggaaaaaatnaggcctctgattcattaagttggccacatggacttnatttggana

SEQ ID NO: 26723 - DNA, 224 bp, Homo sapiens
  misc_feature 6, 17, 31, 82, 137, 140, 171, 206, 209, 211: n = A,T,C or G
ccagcncttacaacagngctagggccatagnagatactcaataaatacaattgaataaataaatgaaaaaatgcatttatangtgatccattacattatgtttttgaatgagtaacttgaaatttaagtagcttagnganggataaataagtttagaagaaaaatagtggngaactataatacaactaacaagttaaaaaacaaancantngattttcctctac

SEQ ID NO: 26724 - DNA, 500 bp, Homo sapiens
  misc_feature 3, 16, 34, 47, 60, 86, 487: n = A,T,C or G
ccngggtccccggttntttatggcggggttgacntgagtataccagnttatatataaatntgtttttaaacttgacaatcattacnctaaaacagatttgataatcttattcacagttgttattgtttacaggaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtgggatataaaactgttgggtattctacaacttcaatggaaattattacaagcagattaatccctctttttgtgacacaaggtacaatctaaaagttatattgggaaaacatggaaatattaaaattttacacttttactagctaaaacataatcacaaagctttatcgggttgtataaaaaaaattaacaatntaatggcaatagg

SEQ ID NO: 26725 - DNA, 397 bp, Homo sapiens
  misc_feature 2, 33, 45, 52, 72, 92, 108, 150, 295, 320, 364, 388: n = A,T,C or G
gngcggatccaggaggggggccccctctaaagnagagaaggctgngccaagnatcttcgattcaactgtccnacaaaggccaccaatatganggggcacccggggtgnttattttattgcttcaaaagcaggggactggcttttggattnaaagggggcaaaggcccaggaaaggagaggaagctttatttacaaccagggaggctgtgggttgactacctgcaacaggcttttaaaggaagcaggtttttcaccgagccctaaaaggaatgaaaatgaaaatattgataaaagncataaaaggaaggaaaaaggaaaanggaaaagcctgaaagtgggcaaagaaggatgataaaaaagagcnaggaaaggaaaaatataaaggggngaggaaggc

SEQ ID NO: 26726 - DNA, 363 bp, Homo sapiens
  misc_feature 1, 4, 34, 48, 51, 62, 65, 70, 71, 78, 81, 89, 105, 124, 133,151, 181, 358: n = A,T,C or G
nacngagcagcctgttgaaattagacagcagggncacccttggtcctntgngccacaggaanggnggggnnctgaagngtnaggttgtnggggggggagcaggtntccaggtgggaattccagnagctgaganggctgccatcaaccaagngagacatgaccagcccccgagttgctgcanaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcccagagaggagaaaaggagacagcaagacgccantaaag

SEQ ID NO: 26727 - DNA, 195 bp, Homo sapiens
acacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatccc

SEQ ID NO: 26728 - DNA, 160 bp, Homo sapiens
acagaatgggagaacatttttgtaatctactcatctgataaagggctaatatccagaatatacaatgaactcaaacaaatttacaagaaaacaacaaccccatcaaaaagtgggcgaaggataccgaacagacacttcttgaaagaagacatttatgcag

SEQ ID NO: 26729 - DNA, 467 bp, Homo sapiens
  misc_feature 15, 31: n = A,T,C or G
gtatttaatttattntaccaaagtgatacanaatctggaattttactgtttgtgtaacatcctttctaaagttttttctttttcttatcatttcaagaaacagaatcaatgccagggccagagactgtgcttgaactctattcaggattcccattgatatcagcaggagttaatatttaagtgttgttttcagtcaaagtaaaatatggtttctctagttttaatgaacaaatagcttcatttggttcacgtccaaatataattagtaactactaccactcagttaaatacccaactttgatgagtatgaatcaaaatggatttgaccttttagctgataattttgggggaaatttggagacctagaaatgaatatatacttaggcataaactgtttaaaattagtttttatcttaaacagatgacttctgcaagagtcaacccttctcatcttcaccttagttgta

SEQ ID NO: 26730 - DNA, 418 bp, Homo sapiens
atcttgtatgagtccatttataagaaatatccagaataggcaaattcacagaaacagaaagcagatgagcggttgccagaggctgaggagagagggcaatagggactggagtggctgcttagtgggtacagggttttctgttgggtgatgaaaatgttctggaactaggtagtggtgatggttgcacaacattgggaatgtgctaaaagccactgaactatacactttaaactggtttaaaatggtgaaagtgatacattaattttaccttaattttttttaaaaaaaacagtgttatgaacagacacgatagctcatgcctgtaatccagacactttgaggggccaaggcagggaggactgctgagaccaggagttcaacaccagcctgggcaacatagcaaggccctgtctttagc

SEQ ID NO: 26731 - DNA, 307 bp, Homo sapiens
tcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 26732 - DNA, 174 bp, Homo sapiens
ggggaagatttataggtagaggcgacaaacctaccgagcctggtgatagctggttgtccaagatagaatcttagttcaactttaaatttgcccacagaacccctaaatccccttgtaaatttaactgttagtccaaagaggaacagctctttggacactaggaaaaaaccttgt

SEQ ID NO: 26733 - DNA, 145 bp, Homo sapiens
  misc_feature 6, 32: n = A,T,C or G
ctgggngttggagattgcagtgagccacgatngtgccactccactctagcctgggtgacacagtgagaccctgcctcaaaaaaaagaaaagaaaagggaggggagggaagggaaaattaaaaaaaaagaaaagaaaaaagaaaag

SEQ ID NO: 26734 - DNA, 384 bp, Homo sapiens
  misc_feature 141, 157, 194, 197, 204, 229, 255, 257, 293, 316, 324, 345: n = A,T,C or G
caaggactaacccctataccttctgcataatgaattaactagaaataactttgcaaggagagccaaagctaagacccccgaaaccagacgagctacctaagaacagctaaaagagcacacccgtctatgtagcaaaatagngggaagatttataggnagaggcgacaaacctaccgagcctggggatagctggntgnccaaganagaatcttagttcaactttaaattngcccacagaaccctctaaatcccctngnaaatttaactgttaggccaaagaggaacagctcttnggacactaggaaaaaaccttggngagagagnaaaaaatttaacacccatagnaggcctaaaagcagccaccaattaagaaaagcggtcaag

SEQ ID NO: 26735 - DNA, 257 bp, Homo sapiens
  misc_feature 4, 31, 257: n = A,T,C or G
aganacgaaatggacatgaatactatggcgnttactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcn

SEQ ID NO: 26736 - DNA, 202 bp, Homo sapiens
  misc_feature 6, 30, 115, 143, 149: n = A,T,C or G
attaantaaaaagcattctattaacagtantttcaaaaacttaaatacttagaaataaatctgacaaaaatgtgcaaaacttatatattgaaaattgtaggctgggagtggtggntcaccgactgtgatcccagcactttggnaggcangaggtgggcatgatcacctgagctcaggagtttgagaccacccggggcaacgt

SEQ ID NO: 26737 - DNA, 363 bp, Homo sapiens
  misc_feature 32: n = A,T,C or G
attatttctgtgggaaagttgctcttcacctnttgtttaaagtaagcttccttggctaatttaagaggtaccggccaggtgcagtggctcacacctgtaatcccagcactttgggaggccgaggcaggtggatcacgaggtcaggagatcaagaccatcctggctaacatggtgaaaccccgtctccactaaaaatacaaaaattagccgggcgtggtggtgcacgcctgtaatcccagctacttgggaggctgaggcaggagaatagcttgaaccagggaggcagagattacagtgagctgagattgcaccaccgcactccagcctggtgacagagtgagattccatctcaaaaaaaaaagg

SEQ ID NO: 26738 - DNA, 488 bp, Homo sapiens
  misc_feature 32, 33: n = A,T,C or G
attcatcgggggaaataattctttgatacttnngaaaataccacagctgactaaaagaataaataaaactgttacatctcaagaggtaatatgatattaaaaattgattatgtgtactgcatccattaaaattcacattaataaataattactagtttttaacatcaatatgttacataattcttgtatcaaatatatttcttgggaaagaaaataaacaaaataaaaaataatatttttaataccaggaatttgacctaaaaaactaattaattaatacatgttgagcaggagtagagaagaggaaagtaaaagtgtgataagtctcttatataggagaaccagtaatagtcttccattcttataattggttgaaaattacatatatatgctaatctctgtgtatatgtatatttttatatacatataatgtgcatatgtgaatatatatataactgtagaacaaaaatgtgcattctacaaatggg

SEQ ID NO: 26739 - DNA, 490 bp, Homo sapiens
  misc_feature 29, 429, 469: n = A,T,C or G
aaacccaaagtaagatattcggtatttanttctttgttatcaagcacattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagtccgtctttatgtttaaaactaatttcttaaaataaagccttcagtaaatgttcattaccaacttgataaatgctactcataagagctggtttggggctatagcatatgctttttttttttaattattacctgatttaaaaatctctgtaaaaacgtgtagngtttcataaaatctgtaactcgcattttaatgatccgctnttataagcttttaatagcatg

SEQ ID NO: 26740 - DNA, 490 bp, Homo sapiens
  misc_feature 1, 7, 30, 32, 466: n = A,T,C or G
ngatgcntgaagttgaagatgtgaatatantntctcaaggaaaaggatgatgtgagagcaagagactgttggaaagcagaagaagaacccatatatagggtcaagaagaagcagaagagcctgcaaaggaagagaaaagggcaggagaagagccaaaaagtatgaagccagtgagaggacagtgtttttgaaagaaaggagttgtcaagaatgtcaaaacatctgagatataaagtaaggtcaagtcaaaatatattcaattggatttgaccgtcttgtgatttgcgatcttggtgggaataattaaattatgttataagggcagaagtcagttttcagtggactgtaaacaggatgaggggtaaagaagtaaaaactctcttcaaagatttgactagaaataatagagaagaaagtggtaacaggagcaaatcttcaaaaaaggattttctttcttttctattgnatgcttatttttatgtatatttga

SEQ ID NO: 26741 - DNA, 490 bp, Homo sapiens
  misc_feature 3, 5, 30, 31, 441: n = A,T,C or G
agnancccagagttgaaatacctccagatnntcttccttcattctaattcaattgccagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagnttctttttgcgtacaaatgatcttacataaatctcatgcttgaccattc

SEQ ID NO: 26742 - DNA, 310 bp, Homo sapiens
  misc_feature 51: n = A,T,C or G
gaagccgccaaagcccttagacaagcgccatttccatctttgtgtgcttgnatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggct

SEQ ID NO: 26743 - DNA, 490 bp, Homo sapiens
  misc_feature 32: n = A,T,C or G
atacccactgtcaatgaaaaccttgaaaactnttacctggaggtcaatcaacttgagaagtttgacataaagagcttctgcaagatcctggggccattatcctactccaagatcaagcatttgcgtttggatggcaatcacatctcagaaaccagtcttccaccggatatgtatgaatgtctacgtgttgctaacgaagtcactcttaattaatatctgtatcctggaacaatattttatggttatgtttttctgtgtgtcggttttcatagtatccatattttattactgtttattacttccatgaattttaaaatctgagggaaatgttttgtaaacatttattttttttaaagaaaagatgaaaggcaggcctatttcatcacaagaacacacacatatacacgaataggcatcaaactcaatgctttatttgtaaatttagtgtttttttatttctactgtcaaatgatgtgcaaaaccttttact

SEQ ID NO: 26744 - DNA, 210 bp, Homo sapiens
gttggctccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttc

SEQ ID NO: 26745 - DNA, 192 bp, Homo sapiens
catcttggttccgcgttccctgcacaaaatgtccggcgaagccacagaaaccgtccctgctacagagcaggagttgccgcagccccaggctgagacagggtctggaacagaatctgacagtgatgaatcagtaccagagcttgaagaacaggattccaccccaggcaaccacacaacaagcccagcttggcg

SEQ ID NO: 26746 - DNA, 488 bp, Homo sapiens
  misc_feature 7, 30, 32, 251: n = A,T,C or G
aatgtcncatccctggttgagctggatctntnctataacaagcttaaaaacatacccactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagncactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgt

SEQ ID NO: 26747 - DNA, 490 bp, Homo sapiens
  misc_feature 1, 30, 31, 317: n = A,T,C or G
naactcccaagaacacggaaccattaattnnttcggtcttcacaagcaaagttatgcgcatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggnctcaccctccatcatgcataaaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcaga

SEQ ID NO: 26748 - DNA, 466 bp, Homo sapiens
  misc_feature 15: n = A,T,C or G
atagctactttatangaaacaggagtcataggttgaatttttatgtgggtagtagagctaagaatatttgtaaaacagctctccatgatgggctccaacaggatgaagtaagaccacctaccaaggaagtaagatcagttccaaaatgaactgtacatgaaattctgctctaagatctttttgctttttaacatgatttcagaaaaggctaatttttgtaatggactacaatacttgttttgctacataagctttcaggattttttttcttttatttttattttaaaattaatttttgagcagcattcttgactgcaagaaagcttctgtcagtttcccaaattactcaaataacatgtattttacactgaaaatcatgagctccttaactcaaagcttttccttgttgtttttgtaactatttaccatacaattacttgtaaatgaaatgtataacataaatatg

SEQ ID NO: 26749 - DNA, 476 bp, Homo sapiens
acagttggagataagctctatgtcattggtggcaatcacttcagaggaacaagtgattatgatgatgttctaagctgtgaatactattcaccaacccttgaccagtggaccccaattgccgccatgttaagaggccaaagtgatgttggagttgccgtctttgaaaataaaatctatgttgttggtggatattcttggaataatcgttgtatggtagaaattgtccagaaatatgacccagaaaaagatgagtggcataaagtttttgatcttccagagtcacttggtggcattcgagcctgtacactcacagtttttccacctgaagaaaaccctgggtcaccttctagagaatcacctctttcagcaccttcagatcattcttaggtctaaggtgtaacacctttgcagtacgtcatgggtgatctaatacttccccttcagttgtatcttcttacagtgattggtacagttat

SEQ ID NO: 26750 - DNA, 485 bp, Homo sapiens
ccttatggccgggggaggaagacgcggtcgtaagggctgaggatttttggtccgcacgttcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtgggaaagtcaccattgcag

SEQ ID NO: 26751 - DNA, 179 bp, Homo sapiens
  misc_feature 5: n = A,T,C or G
cgagnactgtggtaatcaggctgtagaagaacgactacaaaatattgaggcccacttgcggttacagacaggtggtccagtgccaagagacatttatcagagaattaaaaaacttgaggataaaatccttgaattggaaggcatctctcctgaatattttcagtctgtaagcttttctg

SEQ ID NO: 26752 - DNA, 135 bp, Homo sapiens
  misc_feature 18, 29: n = A,T,C or G
cacccagggaattcggcnttatggcctgnaggatccggccgcctcggccagtcgactctagactcgagcaagcttatgcatgcggccgaattcgagctcacttggccaatttcgccctatagtgaggttcgtata

SEQ ID NO: 26753 - DNA, 144 bp, Homo sapiens
ataagtaacatgaaaacattctcctccgcataagccctgcgtcagattaaaacactgaactgacaattaacagcccaatatctacaatcaaccaacaagtcattattacccccactgtcaacccaacacaggcatgctcataag

SEQ ID NO: 26754 - DNA, 116 bp, Homo sapiens
gctaaacctagccccaaacccctccaccttactaccagacaaccttagccaaaccatttacccaaataaagtataggcgatagaaattgaaacctggcgcaatagatatagtaccg

SEQ ID NO: 26755 - DNA, 137 bp, Homo sapiens
  misc_feature 137: n = A,T,C or G
ggtggtgggttcctgtaatccagctactcgggaggctgaggcaggagaatcgctgaaactcaggaggtgaaggttgcagtgagccgagattgcactactgcactccagccctgagtgacagagcgagactctaagan

SEQ ID NO: 26756 - DNA, 281 bp, Homo sapiens
  misc_feature 20: n = A,T,C or G
gtagaattaaactagaaatngtagtggaaacatgcctgagaaatccctaaatatttcgaaattaaacaacactcattcaaactatgggtaaaagaagtctcaagataaatttttttaaaatttgaactaaaaattataataaaattcgtcaaaatttgtgggaaagaaatgctaagagaatgcaaaggcaatagccaaagtttttacattagaaaactggcaaaagaagagcacatgaaatttaaatcaagaagaaggaaataaataataaaaactagaga

SEQ ID NO: 26757 - DNA, 373 bp, Homo sapiens
gtgcctgagacacagacccctttgcattcacagagaaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaatt

SEQ ID NO: 26758 - DNA, 467 bp, Homo sapiens
gttctcgcagcaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagttgaaaagacagaaggtaaaattgcggagttgctctctccgggctcagtggatccat

SEQ ID NO: 26759 - DNA, 353 bp, Homo sapiens
gagatgatttttgatcctactatgggcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttga

SEQ ID NO: 26760 - DNA, 223 bp, Homo sapiens
  misc_feature 3, 13, 28, 44, 45, 46, 47, 60, 67, 75, 86, 108: n = A,T,C or G
cantgccgccttncttggcccaacttantgcccttcttcaagannnntcacccttacccnacttgcnaagaaacnagcattgcatnaccatgggattgaagggaagancttggcaaccctggaaaaaaggcctgtcattcttacagggctctaaatgatgttgaactttgttgctgagggcaacagcaggttcacttacacccgttcttgtagatggctgctc

SEQ ID NO: 26761 - DNA, 497 bp, Homo sapiens
  misc_feature 10, 12, 454, 471: n = A,T,C or G
aattcggccntntattggccgggagggtatttgaatacattgtcgtggttggtggtcttaaaaatatgcacatctctgggagaagggggaatttagagttggtaaagaaatgctttattcatgctaaactactgtatttaggacatgttgctaccaaaagaaaaagaatcagtgtaatctttgcagaggcaggtggcttgggctttctgcgtgagtagtcagaagacccttctggagggctttttttgtgtgtggttcgtgtatattaaatcctcccttaaataaacatattcttactataacatttaaaacgcttggcaaccaacaaaagccccatcggagagagtgccggtggatctcttcagagctcaagagaagaggccttcgggattcccattcattcatccatccgggcttcgaccctcctttgggtcttttcatatttgcaattgcntttcccccgggaaatgnaaattttttttttgggcccttcccca

SEQ ID NO: 26762 - DNA, 287 bp, Homo sapiens
  misc_feature 273: n = A,T,C or G
gaggcattgaggcagccagcgcaggggcttctgctgagggggcaggcggagcttgaggaaaccgcagataagtttttttctctttgaaagatagagattaatacaactacttaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagt

SEQ ID NO: 26763 - DNA, 474 bp, Homo sapiens
  misc_feature 1: n = A,T,C or G
nggtgagagtcaagctgaccatggatccctggggccaacggcacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacct

SEQ ID NO: 26764 - DNA, 114 bp, Homo sapiens
  misc_feature 14, 17: n = A,T,C or G
ggtgtttattttcnatnagtgaagatatctcctacttctcctactggaacatctcagcttctgcagtgaagaaaaattcctgtgatagttcagttctttagtttttctatttga

SEQ ID NO: 26765 - DNA, 469 bp, Homo sapiens
ggaggctttgaggcagcccgcgccggggccttctgctgagggggcaggccggagcttgaggaacccgcagataagtttttttctctttgaaagatagagattaataccaactaccttaaaaaatattagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaacgtatttaaaagaaaattgagagaaaggactacagagccccgaattaataccaataggagggcaatgcttttagattaaaatgaaggtgacttaaacagcttaaagtttagtttaaaagttgtaggtgattaaaataattttggaaggcgatcttttaaaaagagatta

SEQ ID NO: 26766 - DNA, 470 bp, Homo sapiens
  misc_feature 21: n = A,T,C or G
acacatatataactacacagnacaggcagaagaaaatccagtaaccacaagattattcatttgccaacctccgggttgagcccataaagagacaggattaggaaaacatgaagcttctaaggcctaataaacagttataactgggaggcaaaaacagattttgagagggatctattcacttttaatttctggggtttcatgaggaaaacagaggtctctcccctctcatgcaagaattaagggtggcaaggcaaaatggagaaaaataattcagttgactagaaaaagcccttttccagcaaaacaagacccaggaagagaaaaacataaaggccttttaaatatacctataatttggatatccacttttaattaagctgagtgctctttaagaaaattcttttaaattctttgttatccgactttagctgcgcgaagtggtcagtgtttctggctttcaaactttactg

SEQ ID NO: 26767 - DNA, 101 bp, Homo sapiens
  misc_feature 7, 22, 30, 39, 61, 87, 92: n = A,T,C or G
atcttcnaccgaatcgcttagntaatcatnttcctacancagtcaattacaaatattgcangtcatataacaagtaaatgaggcttntactncataataag

SEQ ID NO: 26768 - DNA, 471 bp, Homo sapiens
gataggggttggaatctgaagttggttgtatgactttgcttcagttcatgtatacttaatataccctggaaatgaatctgttagggaattgtccccattcgtatctggaaagaattatagattaagttcaccttcttggctagtgttcagtagaaattagtattcatctagttcactgtcattacaccattggcacagcacttagtaaatctcaatagtcctgtttctagattcctgaatcagagttctccaaatgaagccaaagaagtgattttagaaggacaagataatttctgtacttggaagtataataaatagtggaagggaacacgaattttggatagattcactgtgaaatcagcaaattaagatctaaaccaactttccctctatgtagccattggtctgaaatatggccaaaggaagcctttaagtcctttttgaggatgtaaacaggttttgaaggattat

SEQ ID NO: 26769 - DNA, 419 bp, Homo sapiens
  misc_feature 4, 25, 41, 46, 78, 358, 372, 405: n = A,T,C or G
accntaaaagctggtgtagtcagcngaaatcccttaacaantttcntctgattggtttaaacaaatgagcactcctantaaaatgtactagtaattaacccccagttttttttagttgatgtgacttaagtaaatctttgataaattaattggttttaaaattgtggataaaataaaattagaaatgtcttcaaaattgtcagcagacatttttatctgggtttactggtcagacagttttatatttgcctctgctagatgtttttaaagtcataaagcctaaaacaaaatgatctttgtttatataggtttttaaataaatatgattatattgggtggttttaataaaaatagctgnaactttttctgagntagcaccaggggggctggttttaactttaaggntcttacttaaccct

SEQ ID NO: 26770 - DNA, 177 bp, Homo sapiens
  misc_feature 84, 164, 166: n = A,T,C or G
gggcgagggaccaaagtagaaagaagtgacagagtatggaaaagggagaaagatagggagaaatattcccaaagagaacaaganagagatagacaacaaaatgatcagaaccgacccagtgagaaaggagagaaggaagagaaaagcaaagcaaaggaagagcntntgaaagtaagg

SEQ ID NO: 26771 - DNA, 473 bp, Homo sapiens
gagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaattggttcccttattgatgtcaatcaatccaaggatccagaaggcttacgagtattttattatcttgtccaggacctgaagtgtttggtcttcagtcttattggattacacttcaagattaaaccaatctagactgaatattggtgtggacatggggggtgggtggggagtagaaaattttgtgtttatcaagggcagtattttttttatgaactataaat

SEQ ID NO: 26772 - DNA, 470 bp, Homo sapiens
  misc_feature 2, 26, 31, 38, 51, 86, 101, 136, 200: n = A,T,C or G
gncaaatgctcttgaaaacagtcccnagggnacctggngtacctacaactnagactcctgcggcgactaaacctgaaatgactacnacagctataagacangacaacagaaagagacttacgtactacacctgaanctacaactgctgcacctaagatgacaaaagagacagcaactacaacagaaaaaactaccgaatncaaaataacagctacaaccacacaagtaacatctaccacaactcaagataccacaccattcaaaattactactcttaaaacaactactcttgcgcccaaagtaactacaacaaaaaagataattactaccactgagattatgaacaaacctgaagaaacagctaaaccaaaagacagagctacctaattctaaagcgacaactcctaaacctcaaaagccaaccaaagcacccaaaaaacccacttctaccaaaaagccaaaaacaatgc

SEQ ID NO: 26773 - DNA, 261 bp, Homo sapiens
  misc_feature 45, 50, 57, 74, 90, 124, 138, 185, 212, 219, 250: n = A,T,C or G
agattaaaaaaaaaaggaaaccaaagtaataagaaattgctgggngtggnggcttgnccctgtgatcccagctntttgggtggctgaggnggagggaactgccttagccccaggacaacatagngagacctccatctntaaaaaaaataaaagcaaattagctgggcatggggatgcatggctgnggtctcagctacttgggaggctgaggngggagtntcacttgagtccaggagttcaaggctgcagngagctatgatc

SEQ ID NO: 26774 - DNA, 456 bp, Homo sapiens
  misc_feature 141: n = A,T,C or G
gaattattggagttttaaattaagtgtattggaaaagaaaggatggtatgtgtgtgaaatgttaagatcctacgcaacactgctatctctttttcctttaatatttgtgctgcataacaaaagccactagactgttactgncttgtctgtccatgtgttcacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatat

SEQ ID NO: 26775 - DNA, 476 bp, Homo sapiens
  misc_feature 8: n = A,T,C or G
cccccganacagaaatgaaagcaacagggcacagcgaataatgctatctttctgcttctgtgacaagtctcaggtgctaaacaaagagaaggacatttcccagatctccaagttagtccacaaaaccgacagctctgatggctcgcagagctctgtattagcgggtgttcaggggaaatacaaaacatcatcgagagcctggtccctgtctaggatttaatgatcaaattggagaccagacacacacacccggccaaagaacacctaataacataccatgtggtgactgatactctatatgttgaatgtatctgtagcaaaaggaagaaaaggcaggttttgaaaagaggagcatgggacgggcgcagtggctcacgcctgtaatcccagcactttgggaggccgaggcgggtggatcacctgaggtcaggagtttgagaccagcctgaccaacgtggtgaaaccccctctctact

SEQ ID NO: 26776 - DNA, 403 bp, Homo sapiens
gtcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatat

SEQ ID NO: 26777 - DNA, 118 bp, Homo sapiens
aatgcatcatttgaaaataccaaggaggaaataccctttgtttttaatgatgcaagagtggacgtaatgctagttggcagtattttattgtaagaaatcaataaagtaattgtgtttt

SEQ ID NO: 26778 - DNA, 300 bp, Homo sapiens
gaagggttgtgttcttcaggggtcttttgttttgaaatactcaggatggggagaggtttatttaagaacgaattataattatggtttacactgttgggagtaaaggagcatttttacaccccttaagggtgcttaattctgctgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgaga

SEQ ID NO: 26779 - DNA, 464 bp, Homo sapiens
  misc_feature 459: n = A,T,C or G
atccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctgganggtgt

SEQ ID NO: 26780 - DNA, 265 bp, Homo sapiens
gaggcataagaattgcttaaacctagatggcagacactgcagtgagctgagatcatgacaccgcactccagcccctatgtaacagagcagactctgtctgaaaaaaaaagaaaaaaagaaacaaaatgaaaaatggtaacatctgggacatgaccaggaggaggtttttttcccctcagcttcctaaaaatcattcattgaaagctttatttgaatttaccttgcttgggatactacagtattcataaaatgtcataggtaaagc

SEQ ID NO: 26781 - DNA, 115 bp, Homo sapiens
  misc_feature 31: n = A,T,C or G
ggtgacggggaatcagggttcgattccgganagggagcctgagaaacggctaccacatccaaggaaggcagcaggcgcgcaaattacccactcccgacccggggaggtagtgacg

SEQ ID NO: 26782 - DNA, 458 bp, Homo sapiens
gatctcagctcaccgcaacctctgcctcctgaattaagtgattctcctgcctcagcctcctgagtagctgggatttcaggcatgtgccaccatgcctggctgattttgtatttttagtagagatggggtttctccatgttggtcaggctggtcttgaactccccatctcaggtggtccacccatcttggcttcccaaagtactgggattacaggtgtgagccactgtgcccggccctctgacttattcttgagagatttatcagtttgtgaatggatcaaaagcatacaactgaaaattaaagaacagaaaaatagatgtagtttgacttactacatcttaaaaatgcattcatgatctcccttagtgatcttttttcttaagagtttttggactcttgccctcccccacaaatagggtagaataagagaataagctgagtatttaaactagggtaac

SEQ ID NO: 26783 - DNA, 471 bp, Homo sapiens
taagaattattttcttaaaaatataaccacattaccaaaaaaattaataatattccttcttgtcatcaaaatccagtcagtgtttaaatttccaagtgtctcataaatcacaatttttaatgtttatttaaaattttatttgaatttacttaaattatttgaatcaggtccacacatgatgattaatatgacattaagcctcttttaatctatgggtttcataatttttactttttttctttattattcgttgaagaaaccacataatctgttctgtactttcccacagcaaattctttattaattttgatttagataaagcctcaggaattacggctacctctgacttaacatgagaagaaaacacgttagaaattatggacagatatatagttagccaggaatgtacagtgtctgaagaatagcgttttgtattgaaatttctttggcgttaaaatcatacatgtatga

SEQ ID NO: 26784 - DNA, 379 bp, Homo sapiens
  misc_feature 70: n = A,T,C or G
ggaatacttataaatggcgccgaagcaggacccgaagcctaaattccaggagggtgagcgagtgctgtgntttcatgggcctcttctttatgaagcaaagtgtgtaaaggttgccataaaggacaaacaagtgaaatacttcatacattacagtggttggaataaaaaaagtgctgtgaggcccaggcgctctgaaaaatctttgaagacacatgaggatattgtagccctttttcctgttcctgaaggagctccctcagtacaccaccccctcctgacctctagttgggatgaatgggttccggagagcagagtactcaaatacgtggacaccaatttgcagaaacagcgagaacttcaaaaagccaatcagaaaacg

SEQ ID NO: 26785 - DNA, 164 bp, Homo sapiens
  misc_feature 162, 163, 164: n = A,T,C or G
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcctnnn

SEQ ID NO: 26786 - DNA, 466 bp, Homo sapiens
  misc_feature 19: n = A,T,C or G
gggactcaccgctctggcngggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaacatccctggaattactctgcttaatgtaagcaagctgaacattttg

SEQ ID NO: 26787 - DNA, 411 bp, Homo sapiens
  misc_feature 6, 388: n = A,T,C or G
gacttnaactatactacaaggctacagcagccaaaatagcatgctactggtaccaaaacagatatatagaccaacggagcagaacagagacctcagaaataccaccacacatctaaaaccatctgatcctcgacaaacctgacaaaaacaagcaatgaagaaagggtctctgattcagtaaatggtgctaggaaaactagccagccatatgcagaaaatggaaactggactgcttccttataccaaaattaactcaagatgggttgaagatttaaatgtaaaatccaaaaccataaaaaccctaggagaaaacctagggaggccaggtgcagtggctcgtgcctgtaatcccagcagtttgggaggccaaggtgggtggatcattgangttaggcattcgagatcagcctg

SEQ ID NO: 26788 - DNA, 203 bp, Homo sapiens
aactttgtaaaaggctttcctttcccgtcttctctatccgggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacat

SEQ ID NO: 26789 - DNA, 416 bp, Homo sapiens
gggtccaccttagtcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggtttttttggaggctttttgtaaattgtgataggaactttggaccttgaacttatgtatcatgtggagaagagccaatttaacaaactaggaagatgaaaagggaaattgtggccaaaactttgggaaaaggaggttcttaaaatcagtgtttcccttttgtgcacttg

SEQ ID NO: 26790 - DNA, 107 bp, Homo sapiens
cgcaggaaactgtgtgtgtcctacacaatggtgctattctgtgtcaaacacctctgtattttttaaaacatcaattgatattaaaaatgaaaagattattggaaagt

SEQ ID NO: 26791 - DNA, 411 bp, Homo sapiens
agccttaaaaaggaaagaaattctaaggtatgatacaatatggatgagcctggaggacatggtgctagttaaataagtcagccagcaaaacacaaatcctgtacaattccacttatgtcaggtacctagaatagttaaaatagcagagaggaagtagaatgggggttgccaggggctatagaagagagaaatagagaattattatttaacaggtagagaggtgtcagttttgcaagatgaaaagagttctggagatggatattggtgatggttgcacaacaatgtgaatccatccagtaccactgaactgtacactgaaaaatggttaagatggtctacagacatatcaccctgaacacacccaacctcgtctgatctcagaaaaatggttaagatggcaagactctgtct

SEQ ID NO: 26792 - DNA, 163 bp, Homo sapiens
  misc_feature 14, 163: n = A,T,C or G
agggacagacagcnaggtacagagactcacacctgtactcccaactactcagcaggctggggcaggaggattgcttgagcccaggagtctgaggctacagtgagctatgaacgcacacggcaccctagcctgggcaacaggttgcgaaactgtctcaagacan

SEQ ID NO: 26793 - DNA, 123 bp, Homo sapiens
  misc_feature 2, 9, 21, 28, 47, 63, 67, 72, 76, 104, 106, 115: n = A,T,C or G
cncataaancctgcgtcagantaaaacnactgaactgacaattaacnagccccaatatctacnaatnaaccnaacnaagtcattattacccctcactgtcacancnaacacaggnctgctcat

SEQ ID NO: 26794 - DNA, 472 bp, Homo sapiens
  misc_feature 22, 122, 374: n = A,T,C or G
aaggaaatgcaaaactaaaacncagtgaaataccatttcacacctattataacagttataataaaaaaaaaatcaagtgttgagaagatgtgaagagactagaatcctcatacattgttggngaaaaatgaaaatgttataaacactttggaaaacagttttgacagtttaagagttaaacataaattcaccatatagactaaaattcttctcttaggaatctccccaagagaaataaaagtgtatgtccagaggaagacatgtatacaaatgttaatttcagtattattcataacagccccaaactggaaataatcaaatgtccatgagccaatggaccaccaacaaagtaaagaatatccatacaatatatntagattttattttagccttaaaagggggatgaacctaccgatacatactacataaattaaccttagaaaccagaagtgtgatgtcaccaaaatggcag

SEQ ID NO: 26795 - DNA, 489 bp, Homo sapiens
atctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttct

SEQ ID NO: 26796 - DNA, 121 bp, Homo sapiens
  misc_feature 11, 40, 64, 82: n = A,T,C or G
acactacactnctagaaatttccactttggaagaatactnagcatccaacttgtgattcctganagaacagtactttacttntctagcccagcattgatctaggaagcagaggaatcccag

SEQ ID NO: 26797 - DNA, 283 bp, Homo sapiens
caagtagctggggttacttgtgtaccaccacgcccggctaatttttgtatttgtggtacagacgagatttcaccatgttggccagcttgggcaacatggagaaacctcgtctctactaaaaatataaaaattaactgggtgaggcagcaggcacctgtaatcccagctacttgggagactaaggtacaagaattgcttgaacccaggaggaggaggttacagtgaactgagatcatgccactgcactccagcctgggtgacagagcgagactccaactcaaga

SEQ ID NO: 26798 - DNA, 227 bp, Homo sapiens
gaagtgagaccttccttttacttttcttctattgcctctgagagcatcaggcctagaggcctgactgccaagccatgggtagcctgggtgtaaaacctggagatggtggatgatccccacgccacagcccttttgcctctgcaaactgccttcttcggaaagaagaaggtgggaggatgtgaattgttagtttctgagttttaccaaataaagtagaatataagaga

SEQ ID NO: 26799 - DNA, 316 bp, Homo sapiens
  misc_feature 230: n = A,T,C or G
ggctcactgcaacctctacctcccgggttcaagtgattctcctgcctcactctcccgagtagttgggactactggcgtgtgtcaccacgccaggctaattttttttgtattttagtagagacggggtttcactctgttggccaagatgatctcgatctcctgacctcgtgattcgcccgccttggcctcccaaagtgctgggattacaggcatgagctaccgcccccggnccatttttatttcttaataatcttgaaagtctttccggattttattcattatatgagcttaaatatcaggttccttctattccaca

SEQ ID NO: 26800 - DNA, 145 bp, Homo sapiens
  misc_feature 17: n = A,T,C or G
gagataaagtcaatgcnaacactagctctgtattaatccccatcattactggtaaagcctcatttgaatgtgtgaattcaatacaggctatgtaaaatttttactaatgtcattattttgaaaaaataaatttaaaaatacattc

SEQ ID NO: 26801 - DNA, 468 bp, Homo sapiens
  misc_feature 9, 11: n = A,T,C or G
attccaagnanactctctacaaacgatttgggaaacactccaaggaggctttgttttataatcacgcccttccacttccgggtttcgtcttcttggcttctgatatttatgaccatgcagttccattcaataagtctgagttatatgaaattcccgtcatcggagtgaccctgcccatcatgtggttctacctcctcatgaacatcatcactcagtacgtgtgcatccggggtgtgtttatcctcaccacagaatgcgcctccctcaccgtcacgctcgtcgtgaccctacgcaaatttgtgagcctcatcttttccatcttgtacttccagaaccccttcaccctgtggcaccggctgggcaccttgtttgtcttcattgggaccttaatgtacacaggaggtgtggaacaacctagggaccacaaaaagtgagcctcagaaggacagcaagaagaactgaggcctg

SEQ ID NO: 26802 - DNA, 434 bp, Homo sapiens
  misc_feature 7: n = A,T,C or G
gatgatnagtttgattgcccggctttattgcctttacaggaatgtgatactcagggcttactctatacaccaatgagtcttctttgatcctaagaccaccactgaagttgtttaggttcttttggacaaacatgataaacttcttcagatactttttttttcctttggcaggaaggtgtcttgctgcaggtaactaatgaagaagtggtcaaccacagagtcttcaagaaataagaaattctgtaccatctgaaagtagttcttgttggtgccttcatttaaaaagcactctttaaaataaaagggaaatgttttctgataaaacaaacatttagttgaggttcttgatataaaacaattacaaaatgagtgttgtttgtaaaacagtaacatcaaattggctagagagataaatgtatcatgttttaattagg

SEQ ID NO: 26803 - DNA, 472 bp, Homo sapiens
gtaagtactaatacagcttagaacagatgactctaaccttgtgtaggagctagagaaggcttctctgaggaggtgaggttggaactgaagcatgaaagggaacagaagggggtcaggcaggagaaggcttgggaccaggaggtagagaaaacagtagtgtgatcagaactttaaggcccggttctgtatacaacaggtttcgggacttgaaaggcagcccacattgagtgtaactagaaagtgagggcaagagattgttcaaaagaatactggacccagagtttcatcactttgttaattacatctcatattgtgggattgcaattaccttgcccaagaaaagattatttacgattccattgtttatattgtttgttgaaataattaattctcaaaacttctggatacctgagactcagctaggaacttatttttaaaatataaattcctagtcccactccctaaagattct

SEQ ID NO: 26804 - DNA, 394 bp, Homo sapiens
  misc_feature 2: n = A,T,C or G
cnctgttcctccgtaggcattactagttctcttatatttaaccgtagattgtaaagaaaaataattacttatgcagaatctcttagaaaaatgaaataaaaaacacaaacatcaatttataattatatgttataattaaaaagcttgacacctattgttatccccagaatttgaaccttaataacaggtcttggtcattgttcatcataataacgtatcccgtggtctccatcagtggaattactgagctctgctggagagataacatgttccctgaaaacaggaataacttgacaaaaggaacattgtctgggcagcaaagggacatgaaaacaagtatagtatttttagttttaaaatgtcaatgtcagagaaatttgtgtgtttaatattg

SEQ ID NO: 26805 - DNA, 412 bp, Homo sapiens
ggagtttcagatcttccagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtggggtgtgcctatcataacaattgttttctgtatcttgaaaaagtattctccacattttaaatgttttat

SEQ ID NO: 26806 - DNA, 161 bp, Homo sapiens
ggaacacttcgctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagc

SEQ ID NO: 26807 - DNA, 157 bp, Homo sapiens
gactcttagcggtggatcactcggctcgtgcgtcgatgaagaacgcagctagctgcgagaattaatgtgaattgcaggacgcattgatcatcgacacttcgaacgcacttgcggccccgggttcctcccggggctacgcctgtctgagcgtcgcttg

SEQ ID NO: 26808 - DNA, 133 bp, Homo sapiens
  misc_feature 17, 123: n = A,T,C or G
acccagggaattcggcnttatggcctgcaggatccggccgcctcggccagtcgactctagactcgagcaagcttatgcatgcggccgcaattcgagctcacttggccaattcgccctatagtnggttcgtata

SEQ ID NO: 26809 - DNA, 262 bp, Homo sapiens
gtgtttgatctcttgatttagatagacacgagtttgatttttggtttagctgtttacttacttttgtgacagtaggtaacttttctgaaccttggtttctctgttttaaggatatacgagatagtgttggttgaggactgtgatggttcattttatgttgtaagcatgactgggccacaggatacccagatcctggtaagatattatttctgactgtgtctgtgagggtgtttccgaagagattagcatttgagctagtaga

SEQ ID NO: 26810 - DNA, 438 bp, Homo sapiens
actgtccacctaacataacttggaggctttggctggctcaaccacctgttcactttattttgttttcatttccatttgaacttgaagtgaggctatggaaaggtggaaatcatgggcaaggtttggaggctgcaattctagggcatagcttgtcaggagtttatattatctaaaatatatctttctataccccttttcattttaatctgttgccctgattataatttctttatatttgtggttatttttataagaatagagtccatttgctatgtctatttgagtactttttttctattgtccccacatggatgcagtaccaacctgttaatgaaatatctttttattatattattaaatatgtaattctactgtagaccaaaaatataaaaacaaatttgttcattttaaagatataaagaactagggagtaaaaga

SEQ ID NO: 26811 - DNA, 142 bp, Homo sapiens
aagaaaagggtggggacgcacatccgcgccaagaaggaagcgggaggagctgagcaacgtactggccgccatgaggaaagctgctgccaagaaagactgagcccctcccctgccctctccctgaaataaagaacagcttgac

SEQ ID NO: 26812 - DNA, 472 bp, Homo sapiens
  misc_feature 458: n = A,T,C or G
ggttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtgggtgtttggcaaagtgaaagaaggcatgaatnttgtgggaggccat

SEQ ID NO: 26813 - DNA, 402 bp, Homo sapiens
gaagggtctttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttga

SEQ ID NO: 26814 - DNA, 162 bp, Homo sapiens
  misc_feature 153, 160: n = A,T,C or G
aaagtcttagagagcaagaatttttgtttatttctttctcttcctcctttcctttcttcctcttttacttcgttcactactgattccacataaaatatatttggcatatagtaggtgttcaatatgttgaaggaatgaaagaatttattaggnacctttngg

SEQ ID NO: 26815 - DNA, 471 bp, Homo sapiens
gactgcgtaaaagccctattgcgaaaagttgggtaaggatgaatagacctaatagaatgaagggttgtattaggctcataagggttattactgctcttcagaaatgcaaataagtttaaggaaagtaggggtgaacacttgtgacttccaggaggaagaggagagatcaggctggctgtttgacgggcacagctttattctggaatgatgaacctaatggtggggcatcctgcagacgaacagccattggggtactatagatgactaagtggggtccagtccatggaggttgtagagtttgaggggtcagattcttaacaagaactgatcatccagctagggtgtcttcatatggctgggaatctggagtaggcaagagaagatgagcagcctagcgaatttcctgtctagcctgctggaggactggaagatagttgcctagagggctggtgtctgggacgaggtcagggc

SEQ ID NO: 26816 - DNA, 161 bp, Homo sapiens
gtgtatctgaggtatgtggtcacttaaaaaagtagtatgagaattttaatttatggaagaaaactagattgtcacttatggaaaagggacatgaaaatattaggatataacataatgttgctggctttataacagcaaggaagaaaggatacaagacagcc

SEQ ID NO: 26817 - DNA, 108 bp, Homo sapiens
  misc_feature 25: n = A,T,C or G
ggggaatcagggttcgattccgganaggagcctgagaaacggctaccacatccaaggaaggcagcaggcgcgcaaattacccactcccgacccggggaggtagtgacg

SEQ ID NO: 26818 - DNA, 194 bp, Homo sapiens
gtctgactgacctcagggcctcacctctctgcccttccctgcccggttcctactcacctggctagggccagcgcccattttcagccctacccattgatcatttcaagaaacctctgtttactgtgtggcacccaggcaaaacatgctccacaaattcaacttgtatatttggcagattaaacttgacattatcg

SEQ ID NO: 26819 - DNA, 108 bp, Homo sapiens
  misc_feature 10, 67: n = A,T,C or G
ggggaatcanggttcgattccggaaaggagcctgagaaacggctaccacatccaaggaaggcagcangcgcgcaaattacccactcccgacccggggaggtagtgacg

SEQ ID NO: 26820 - DNA, 262 bp, Homo sapiens; identical to SEQ ID NO: 13300

SEQ ID NO: 26821 - DNA, 472 bp, Homo sapiens
ggggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacacttgtacagttcctcaaccgcttttctacagtttgtgaggagaaactggcagacctttcacttcgtatccaacaaattgaaacaactctcaatattttagatgcaaagttgtcatctatcccaggcctagatgatgtcacagttgaagtgtctcctttaaatgtcaccagtgtcacaaatggagcacatcctgaagccacttcagagcaaccacagcagaacagtacacaagactctggactacaggaaagtgaagtatcagcagaaaatatcttaactgtagccaaggatccaagatatgccagatatctcaaaatggttcaagtggg

SEQ ID NO: 26822 - DNA, 187 bp, Homo sapiens
  misc_feature 15, 47: n = A,T,C or G
cacagtgatcaattngtgtgatattggcaaagggactgacacatggntcaatgaaacaggagaggaaattcagaattaagcccaaacaaatatagccaattaatttttgaaaaagatttaaatccaatggagaaatgataatcttttcaacaaatggggttgaaacaattaaatatccttatatgtt

SEQ ID NO: 26823 - DNA, 159 bp, Homo sapiens
aaaagcagtggctaagatggtatagggactgtcataccagtgaagaataaaagggtgaagaataaaagggatatgatgacaaggttgatccacttcaagaattgcttgctttcaggaagagagatgtgtttcaacaagccagctaaaatatattgctgc

SEQ ID NO: 26824 - DNA, 270 bp, Homo sapiens
  misc_feature 12, 19, 40, 269: n = A,T,C or G
tctccggggtanttcggcntttatggcggggtcataaagnatgaaaataataggcctcaggactccaaaagtggacagtatgggaggacagcaagggctgaaaagttacctgtgggtacaatgttcactgtttgagtattgggtacactaggagcctagtgcccaccagtaggcagtatacccatgtaacaaacaagcatatgtgtccccccaaatctaaaataaaataaaataaaataaaatggaaacagatccacagaaacagttgng

SEQ ID NO: 26825 - DNA, 500 bp, Homo sapiens
  misc_feature 5, 144: n = A,T,C or G
tcccngggaattcggcctttatggcggggattggtaaaaattctggttaaataaaaaattagagatcactcttggctgatttcagcaccaggaactgtattacagttttagagattaattcctagtgtttacctgattatagcngttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaccttctcaaggagcctcctggggactggaaagtaagtcatcagccaggcaaatgactcatgctgaagagagtccccatttcagtcccctgagatctagctgatgcttagatcctttgaaataaaaattatgtctttataac

SEQ ID NO: 26826 - DNA, 309 bp, Homo sapiens
  misc_feature 3, 4: n = A,T,C or G
gcnnttggctgtaaagttatctcagctcttttataacttttcttatattcgcattaaaaggatcactttgagcaccctgtaattaattcagatgattattagcttttttgtttgttctactgtgcactctcctatatacattataacagaagaaaaaaccatttctacaaatacagtgtctgatagttcatcaaatcagaatgagcatcttaaaaagtgaattattaaaatattaattcatttacattcctattttaatgtaccaaatgtaactgatgaaaagaagaataccataaatgggtacctttc

SEQ ID NO: 26827 - DNA, 479 bp, Homo sapiens
gaaaggaaggggaggtcatatggatcatataacactaatgaagatatggaacctgattggttaacttggcctgctgatatgctgcactgtactgaatgtgttgtttgcctagagaattttgaaaatggatgtttgctaatggggttgccttgtggtcatgtgtttcatcagaattgcattgtgatgtggttggctgggggccgacattgttgccctgtttgccggtggccttcttataaaaaaaagcagccatatgcacaacaccagcccttgtcaaatgatgtcccatcttaaccatgtgcaatttgtcctttataagctttgagtatcttacagcttgcctttttaatgttagtcacaatgtttttgtggttttgaagtttagtttaatgttagtgcagtgacgggaaatacacattatgctaatgttgatgacagaatttatttggttgccttgtgtgttaattgaatgcatacct

SEQ ID NO: 26828 - DNA, 431 bp, Homo sapiens
gatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcaagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacggaagcggcatgtc

SEQ ID NO: 26829 - DNA, 477 bp, Homo sapiens
gaatctgggtcagctgcagctggttactgcatttctccatgtggcagacagagcaaagccacaacgctttctctgctggattaaagacggcccacagaccagaacttccactatactacttaaaattacataggtggcttgtcaaattcaattgattagtattgtaaaaggaaaaagaagttccttcttacagcttggattcaacggtccaaaacaaaaatgcagctgccattaaagtcacagatgaacaaacttctacactgatttttaaaatcaagaataagggcagcaagtttctggattcactgaatcaacagacacaaaaagctggcaatatagcaactatgaagagaaaagctactaataaaattaacccaacgcatagaagacttttttttctcttctaaaaacaactaagtaaagacttaaatttaaacacatcattttacaacctcatttcaaaatgaagacttttac

SEQ ID NO: 26830 - DNA, 351 bp, Homo sapiens
gtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctcc

SEQ ID NO: 26831 - DNA, 100 bp, Homo sapiens
  misc_feature 2, 3, 6, 9, 10, 11, 13, 16, 17, 22, 29, 41, 50, 54, 58, 61,63, 64, 69, 76, 77, 78, 88, 90, 94, 95, 98: n = A,T,C or G
annccnagnnngntcnncgcanggttctnatgggtgtcctnctcagagantctncctnctntnnttccntcctggnnnagaaggctcntngccnncancg

SEQ ID NO: 26832 - DNA, 467 bp, Homo sapiens
ggcctgtatggattttatattttcttatattgtagatgtttatgtatacatctatatctaccatatactatagtaactactagaggacaacaaccgtatcataggcaactcttttatgtgcataatctctgcaggatacctttaccattactaatacttagcaaatgttcgtggaaggaaagcgttgcaagaggtagggaggcaggcatgctggctttttaaaatctaattttcatcaacctctaggtcagtggttcccaatactggttgtttatttgaatcactagggaattatttttaaagagcagtgccacacctaacacctatttgattcaaatctctgggaggtaggatcacagcatctatatgtatgttttaaaagttgtccagataatcctaacgagcattggttcaaagtctagtccccagaccagcaacatcagcattgctgggaatttgtaagaaat

SEQ ID NO: 26833 - DNA, 116 bp, Homo sapiens
  misc_feature 13, 17, 43, 103: n = A,T,C or G
cttttttgcgtgnggcnggtttaagttattagtttttaaaatnagtactttttaatggaaacaacttgaccaaaaatttgtcacagaattttgagacccattnaaaaagttaaatg

SEQ ID NO: 26834 - DNA, 411 bp, Homo sapiens
gctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagactttgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtat

SEQ ID NO: 26835 - DNA, 472 bp, Homo sapiens
ggcagaataccatttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatcttttga

SEQ ID NO: 26836 - DNA, 156 bp, Homo sapiens
cataacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgca

SEQ ID NO: 26837 - DNA, 447 bp, Homo sapiens
caacagctcattgagaacgggccatgatgacgatggcggttttgtcgaatagaaaggggggaaatgtggggaaaagaaagagaaatcagattgttgcggcgtctgtgtagaaagaagtagatataggagactccattttgttctgtactaagaaaaattcttctgccttgggatgctgttaatctataaccttacccccaaccccgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggctgcagggtcctctgcctaggaaaaccagagacccttgttcacatgtttatctgctgaccttccctccactattgtcctatga

SEQ ID NO: 26838 - DNA, 321 bp, Homo sapiens
  misc_feature 13, 100, 315: n = A,T,C or G
gaaggccaaaatnagagtgagatgtagaaagttgtaaaatagaaaaagtggagttggtgaatcggttgttctttcctcacatttggatgattgtcataangtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttanaaactc

SEQ ID NO: 26839 - DNA, 472 bp, Homo sapiens
actacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgag

SEQ ID NO: 26840 - DNA, 428 bp, Homo sapiens
  misc_feature 14, 53, 55, 56, 57, 59, 228, 236, 380: n = A,T,C or G
ggtacttcccagcngaaaaaacaccaccaaaatgtgaaatacaaggaaacagncnnnancagaattcacaattacttaatcaaccaaaaattacagcagataaacgctataaatgtagtctgtgtgaaaaaaccttcattaacacttcatcccttcgtaaacatgagaaaaaccatagtggagagaaactatttaagtgtaaagaatgttcaaaagcctttagccaangttcagcncttattcaacatcaaataacacatactggagagaaaccctacatatgtaaagaatgtgggaaagcctttactctcagtacatccctttataaacatctaagaacccatactgtggagaaatcctacagatgtaaagaatgtggnaaatccttcagccgaaggacaaggcctttttatacatcaaaaaattca

SEQ ID NO: 26841 - DNA, 496 bp, Homo sapiens
  misc_feature 10, 18: n = A,T,C or G
gtattcggcntttatggngggggtaatatttcagaaacaaaacagaatttgttatctcctattttttttattttccatatttgtaagtgggttaccttattagtgagatctccaaatgtatcatttatatcatggcttttacttctagtagggttagtccaaacattttcccccagccattctcattttaattttagtagataattttaaccagaaattttataccaaaatgtacttgatcatttcttcctaacttttctagttaaaacattgaaactatttatggatattggtttatacactgccttcttttgcaggcaaatgaaaacttttctacttcctcaatagttttataaattcctcttggcctatatattcctctctcaggtacattaaagatgaatgggaagttatcaggaagagagaacagaagatacagactgcgatggttcacctttacctgagtattttactgaggtaacaataatacctaaac

SEQ ID NO: 26842 - DNA, 472 bp, Homo sapiens
  misc_feature 6, 98: n = A,T,C or G
ggcggncatgtcttaagaaatcctttgcgctctcggtgcccccctccacgcccaggagcgggggaaccctgcttaagggctttactagggaaaacggngctggttcactggggcgcgtttccgggaaggtgaataccggtgaaagttatgctgagggtgagtaaactcaaaaactgacactcgattcagctattggaaagtttttttaatgtggttggaacaactgagaacttggcaggatgaagacaaagtgtgtgaaaggtattctttggaattttgtggatgcgttttctcagctgaaagagagcctggatcttcattttcttctgatgatctcttatgaaaacttagatatctccagtcttggggataaagatatgagtgatacaaattagttaacaagcttattacagatggtctcaaccacttccactcatatgaacacacacctcacataccacacacattacca

SEQ ID NO: 26843 - DNA, 472 bp, Homo sapiens
gaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcacttgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttcccttta

SEQ ID NO: 26844 - DNA, 200 bp, Homo sapiens
  misc_feature 8, 9: n = A,T,C or G
gaaagaannggaaaacttcgaagcccctttccactgccttgcaaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgcc

SEQ ID NO: 26845 - DNA, 179 bp, Homo sapiens
atctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgt

SEQ ID NO: 26846 - DNA, 330 bp, Homo sapiens
  misc_feature 7, 11: n = A,T,C or G
ggacccnttgnttgatgcactgagcatggtggctttctgagtcctgttggccaccaagtgtcagcctcagcactcccgggactattgccaagaaggggcaagggatgagtcaagaaggtgagacccttcccggtgggcaccgtgggccaggctgtgtgagatgttggatgtttggtactgtccatgtctgggtgtgtgcctattacctcagcatttctcacaaagtgtaccatgtagcatgttttgtgtatataaaagggagggtttttttaaaaatatattcccagattatccttgtaatgacacgaatctgcaataaaagccatcagg

SEQ ID NO: 26847 - DNA, 469 bp, Homo sapiens
caagcatccaatttctcgtgcccgaaatcaggtggtgataagagcagagccccaactctgtgccttgtgtgcggatctctgctgtgctcccagagttactgctgccagactgaactggaaggggaggatgtaggagcctgacagctcacacctactcctgtggctccggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggattttttt

SEQ ID NO: 26848 - DNA, 500 bp, Homo sapiens
  misc_feature 17, 184: n = A,T,C or G
tcccggggaattcggcnttatggcgggggaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggngtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatataga

SEQ ID NO: 26849 - DNA, 103 bp, Homo sapiens
  misc_feature 3, 19, 33, 60, 73, 77, 78, 81, 83, 84, 94, 98: n = A,T,C or G
ganagaaaacactgaaatntttatggtgaaacngggcctgggatttgttttaaaactatnttaacacaagaangtgnnagnannaaataaaatntgangctga

SEQ ID NO: 26850 - DNA, 137 bp, Homo sapiens
gacagccccgctcccagtatgtaaagaacgcgacttccacaaacctggattttttatgtacaaccctgaccctgaccgtttgctatattcctttttctatgaaataatgtgcatgataataaaacagctttgacttc

SEQ ID NO: 26851 - DNA, 496 bp, Homo sapiens
  misc_feature 16, 17: n = A,T,C or G
gtcccgggaattcggnnttatggcctttttagtattgcagtctaaaacttcaaaaactaaaatcttgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagttaaaagtaaaattgtttcagagtcacagttccctttatttcacataagcccaaactgatagacagtaacggtgtttagttttatactatatttgtgctatttaattc

SEQ ID NO: 26852 - DNA, 219 bp, Homo sapiens
gggtgtttcccagcttagcacagctttgaaagtggccagtacaaggttgctccagattctagccatcactactgggacctatgctgataaactgagtcccaaagtagttcaatccttgttggatctactctgtagtcagttgaagaatttattgtcccaaactggtgtactacatatggcctctttcggagaaggggagcaagaagacggtgaagaaga

SEQ ID NO: 26853 - DNA, 235 bp, Homo sapiens
agagtgtctacgtgcgctctgcaattcaactcggaaactataagtaattctcaagaaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgcc

SEQ ID NO: 26854 - DNA, 500 bp, Homo sapiens
  misc_feature 17, 19, 27, 306, 307: n = A,T,C or G
tctccggggaagttcgncntttatggngggggattgtatgctaaacaggtgatgagactgagcttcactcttctgagaaaggtttaaaagtagaggaaaatattcaaaagcaaagtcaacaaacaaagctttcttcagatgataaaaccgaacgaaaaagtaaacataggaatgaaaggaaattatcagtattaggcaaagatggaaagccagtttctgaatatattataaaaacagatgagaatgttcgtaaagaaaacaacaaaaaagagagacgcttgtcaggctgaaaaaactaaggcagannccaaatcaagaaggtcaagtgattctaaaattcagaaagattctctgggttccaagcaacatggtatcacattacagagaagaagtgaaagttattcggaagataagtgtgatatggactccactaacatggatagtaatttgaaaccagaagaggttgttcacaaggagaaacgacgaacaaagagcttgtt

SEQ ID NO: 26855 - DNA, 399 bp, Homo sapiens
  misc_feature 5, 374: n = A,T,C or G
gaccncgcctcctccaagtcccagcgaacccgcgtgcaacctgtcccgactctagccgcctcttcagctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaatatggngaatgataataaaacagctttgcct

SEQ ID NO: 26856 - DNA, 214 bp, Homo sapiens
atcgctgcaatgacaccatccctgagacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcattttt

SEQ ID NO: 26857 - DNA, 353 bp, Homo sapiens
  misc_feature 228, 322: n = A,T,C or G
gggcagtgtttcttctgaaattctcaggcagtcagactgtcttaggcaaatcttgataaaatagcccttatccaggtttttatctaaggaatcccaagaagactggggaatggagagacagtcaagggttatgtcaggaaaaggatgagtatcagtttcaacatcagggagcggtggagctgcttgccttcaattttttgctcatccttaccattttgacaatctggntatttaaaaatcatcgattccgcttcttgcatgaaactggaggagcaatggtgtatggccttataatgggactaattttacgatatgctacagnaccaactgatattgaaagtggaactgtctat

SEQ ID NO: 26858 - DNA, 251 bp, Homo sapiens
  misc_feature 5, 17, 33, 48, 160, 162, 222: n = A,T,C or G
tcccngggaattcggcnttatggcggggagggnggatggggggatacnatgagcaggagcaaggggtccaggtacaccttcttgtggaaggacaacactcatcttccagtcatgccacgtggaaacaggccaggagagccaggcctgcctggtatcaggngnccctccagagctaatcctgcagaccttatcaggtcattttgctgatgcctttaccaccgngccccccaaccccccacccatcttcccca

SEQ ID NO: 26859 - DNA, 468 bp, Homo sapiens
  misc_feature 381, 457: n = A,T,C or G
atccaaatatatttttactgattaatttgatgccaaattgatataccaacatttaaattaaaaaattcatgagctaacaagtgactttattttagttccataagagtcaataacaggtttgctccttaaaaatctttatttttatcacttatgagcagtggcatgtgttttcttattataagataggctttgtgaatttatctgtatggggatcaggattttaaaaaacagcattttttaagtgctgttgattggaaatcagtttgtggtaaaatactgagtgtcttattttgtccaaaatctgtttctttgtctagaaagatcctttggcttgaataggagagctgtgtatttcataagagatatgattatatggtttgnctttcttaagatacttccctaaaagttaaatagttccattgtcctgctttcagatgttataatgaatgtgactggncttaaatgggt

SEQ ID NO: 26860 - DNA, 281 bp, Homo sapiens
  misc_feature 20: n = A,T,C or G
atgtactgtagtttttcttnacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatg

SEQ ID NO: 26861 - DNA, 226 bp, Homo sapiens
ggtgtgtcacttgaggtcaggggttcaagaccagcctggccaatatggcaaaaccccgtctctactaaaaatacaaaattagctgggcgtagtggcgcatgcctgtaatcccagctactggggaggctgaggcaggagaatcgcttgaacccgggaggcagaggttgcaatgagctgagatcgtgccactgcactccagcctgggcaacagagtgagactcagtca

SEQ ID NO: 26862 - DNA, 262 bp, Homo sapiens
aagggcaaatatgcttgttatgaactacactgaaatctaccaaagttaatgtttactttgtgtaggatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggc

SEQ ID NO: 26863 - DNA, 114 bp, Homo sapiens
  misc_feature 1, 12: n = A,T,C or G
ntttttgtcccngggtaattcggcattatggcggggataaccatgcacactactataaccaccctaaccctgacttccctaattccccccatccttaccaccctcgttaaccct

SEQ ID NO: 26864 - DNA, 497 bp, Homo sapiens
  misc_feature 19, 43: n = A,T,C or G
gttagctttgggttgagtntagatattgttttaaattattttnattttaaacaagatgccttctaagctattgagcttattaaaaataattttacatgtttacttagttggagcaaaaataagtctattttaacaaatagctttgtttttgcatgctaaatgtcaggaaaggcatacgatgcacattatgctgttttaaaggttttaccaccccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaccggtttttgtaactaatgtgtttcatttttt

SEQ ID NO: 26865 - DNA, 500 bp, Homo sapiens
  misc_feature 18, 28, 212, 246: n = A,T,C or G
gtcgcgcggggaattcgncctttatggngggggttacatcttaattatgctacagacaggtagacttattttacatatgtgaactaactagttgtcaaagcaaatgcggattgtattctgcaagtaaagtctttttctctccgaaatttctagggatgttctttaagtgaaattcatattcaaactgaagattttagttacaagaactgagngcaggattaaagtcttttgtgattcaaacatagncaagagtacaactgtgatatttcatggaagttatgcaataaaatgtctctaacctgcgaacaaatctatcaagcagacggcacagtacttgaatttgaaaccagaaatactggggtttttatataaatgcttcatagatttgttttatgataaagggcacataactctcctaaacctcacaccacctcttgaataggtatagtaagtccacatcaatgctgatgccttagctattattaaactcttacagtatg

SEQ ID NO: 26866 - DNA, 151 bp, Homo sapiens
  misc_feature 2, 36: n = A,T,C or G
gnttttttcccgggaattcggcttttatggcggggnattgcagaaactggccttccatctctctcagacaccaagctgcagatccaggcttttctgggaaagtgaggccaccatggctctggagaagtctcttgtccggctccttctgctt

SEQ ID NO: 26867 - DNA, 399 bp, Homo sapiens
acatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtcccttggacacagctcttcattccattgacttagaggcaacaggattgatcattcttttatagagcatatttgccaataaagcttttggaagccg

SEQ ID NO: 26868 - DNA, 316 bp, Homo sapiens
  misc_feature 26: n = A,T,C or G
caggattaagcgattcctggccaagnaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttca

SEQ ID NO: 26869 - DNA, 300 bp, Homo sapiens
caaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgc

SEQ ID NO: 26870 - DNA, 446 bp, Homo sapiens
gttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaataacttgaccaaaaatttgtcacagaattttgagacccattaaaaaagttaaatg

SEQ ID NO: 26871 - DNA, 148 bp, Homo sapiens
gaaagggaatgattaaaacaatgtaaatctaaattgtatgtcatgcatgttttgagaatggtgaatgtttaatgctcatgaaaattgggggagggggttctattaacacaaagcttctgagatatttaaaataaataattattgccct

SEQ ID NO: 26872 - DNA, 122 bp, Homo sapiens
  misc_feature 8, 50, 107: n = A,T,C or G
gaatactnaggatccaacttgtgatccctgatagaacagtactttacttnctctagcccagaattgatctagaagcagaggaatcccagcgccttttaaaagttgtnatgtgggtgtctttt

SEQ ID NO: 26873 - DNA, 208 bp, Homo sapiens
gacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctcga

SEQ ID NO: 26874 - DNA, 468 bp, Homo sapiens
gattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagac

SEQ ID NO: 26875 - DNA, 466 bp, Homo sapiens
tgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattaagtttttt

SEQ ID NO: 26876 - DNA, 249 bp, Homo sapiens
  misc_feature 25, 90, 92, 135, 136: n = A,T,C or G
aggatttttggtccgcacgctcctnctcctgactcaccgctgttcgctctcgccgaggaacaagtcggtcaggaagcccgcgcgcaacancnatggcttttaaggataccggaaaaacacccgtggagccggagnngcaattcaccgaattcgaatcaccctaacaagccgcaacgtaaaatccttggaaaaggtgtgtgcttgacttgataagaggcgcaaaagaaaagaatctcaaagtgaaaggac

SEQ ID NO: 26877 - DNA, 262 bp, Homo sapiens
atttagtgtggtaatattttcatcttgtctggttgcactgttgaagttttgtgcccgtcactactccgagcacttgtcttcctcctgcagccccgtgaagtccctcgtgagcagtgtttcctgcgcaggccctgtgggtgtggactcggggtcctgcatcagggaccttggtgaagacctggtctctgctctgtggtgcccatggcctagcgggcaacagttgagtgtctgttgatttcagccagttcactatgatcggtgt

SEQ ID NO: 26878 - DNA, 367 bp, Homo sapiens
ggtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgc

SEQ ID NO: 26879 - DNA, 294 bp, Homo sapiens
  misc_feature 69, 89, 96, 110, 112, 118, 203, 290: n = A,T,C or G
taagatataaatagaaacaacacaaagttaaaaagtggggagacagtgtaaagtttttattaggcagantttatttaaccaaaacagcntcatagnggcataaaaatagncncacagnccaatgaacacaatagagaatccagaagtaaatctgtacatccacagtgaactcattttcagcagagatgccaagaacatacagngaggaaaagacagtctctttaataaatggggctgggaaaactggatatccatatgtagaaaaatgaaactggacccgtctctcaccntttt

SEQ ID NO: 26880 - DNA, 246 bp, Homo sapiens
  misc_feature 10, 13, 51, 66, 121, 154, 175, 210: n = A,T,C or G
tggggggganganacagcactcctataattccactttggagaatactcagnatccaacttgtgatncctgatagaacagtactttacttttctagcccagcattgatctagaagcagaggnatcccagcgccttttaaaagttgtaatgtgggnttcttttaaaaagctcctgtntttggaaagtagaatttatgggtacaacgtatgtncattatttgtacataaaataaaaccatttaaaaagt

SEQ ID NO: 26881 - DNA, 190 bp, Homo sapiens
  misc_feature 6, 8, 65, 119, 124, 131, 152, 187: n = A,T,C or G
cattangnaacatgtgaaaggtgttttttttttccatatgaactcatgcaagttaccaaaactgngataacccttttttacttactgtaaagagtcattttcataaagatcaattcatngattngtttttngtaaagctatcattcaatatntattataaattaatataaatttaagggaagctctntgt

SEQ ID NO: 26882 - DNA, 145 bp, Homo sapiens
  misc_feature 1, 31, 32, 136: n = A,T,C or G
natacccgccttttccttagaaaaggaggtnntctgtgaagagccgttgtctccagcaacagttcctggcatgcataccgaagacaatccaggaaaagtggaacatacagaagaactttctagtataacaggaagnggtggacta

SEQ ID NO: 26883 - DNA, 132 bp, Homo sapiens
  misc_feature 5, 32: n = A,T,C or G
gagcnccaaggacgactaggaattcacccatnacgacacagtgccctatgtttcttaacttcttgttgccatttgaaactctgtactcttatgtttaaagggttctgtatagccattttttttttcagaaag

SEQ ID NO: 26884 - DNA, 170 bp, Homo sapiens
  misc_feature 10, 28, 30, 135: n = A,T,C or G
aatgcctacnagatattgcttagcgttntntttttaacgtaattttaatagcttaagattttaagagaaaatatgaagacttagaagagtagcatgaggaaggaaaagataaaaggtttctaaaacatgacggangttgagatgaagcttcttcatggagtaaaaaatgt

SEQ ID NO: 26885 - DNA, 151 bp, Homo sapiens
  misc_feature 2: n = A,T,C or G
cncatcctcctgtatactttaaatatttctagattacttgtaatacctaatacaatgtaaatgctatgcaaatagttgttattgtttaaggaataatgacaagaaaaaaaagtctgtacatgctcagtaaagacacaaccatccctttttt

SEQ ID NO: 26886 - DNA, 446 bp, Homo sapiens
  misc_feature 6, 31, 338: n = A,T,C or G
gaggcnttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccganttaataccaatagaagggcaatgcttttagattaaaatgaaggtgacttaaacagcttaaagtttagtttaaaagttgtaggtgattaaaataatttgaaggcgatct

SEQ ID NO: 26887 - DNA, 468 bp, Homo sapiens
  misc_feature 1: n = A,T,C or G
naattgcgacatgtacactactaatgtcgtgagtagaaagattaaagatgaaccaatcaaaaataatgactaaaacaacgtttcaagacacacacagtaataggaatgaatagaaactatagtaataagatatgaatagaaacaacaaactttaagaagtgggggaaaaaaaagtttgaattatatttttctttgcttttcttgtggtatgtttatgcaagcagtgtcaagttgtcatcagtttaaaataatagtttgtaagatattatttacaagtctcatgataacctcaaatcaaaaaacatataagaaatatacaaaaaataaaaagcaagaacttaaaacataccacaacagaaaatcaccttcattaaaaatagggcagggaagaaggatagaagaaagaccacaaaacaactagaaaacaaataacaatatggcaggagtaaatcattacttattagtaat

SEQ ID NO: 26888 - DNA, 500 bp, Homo sapiens
  misc_feature 7, 10, 29, 30, 37, 49, 59, 62, 74: n = A,T,C or G
cccgggncangcgtttttttatgggccgnngatgtcnctcgcaacgggnttgccgccangantacaggtgtcgngaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgacttgtgctgtcctgattgttgctgctggtgttggtgaatttgaagctggtatctccaagaatgggcagacccga

SEQ ID NO: 26889 - DNA, 499 bp, Homo sapiens
  misc_feature 6, 26, 50, 52, 53: n = A,T,C or G
ccggcnctttagggccggggcaaaanaagaaactgtgagaaagaaaatananncacacaggctgatcatttttctaactcagtaaaaccatagatgtccactgtacttatatagtacaaatataagtacttgtggttgcaaatatcagaaaatccaattcaaactcacttaagcaaagcaaaaggaaagaaataatgtattgattctcataactgaaaagctcagacgtatgatggttttcggctaagtttgatccagtgacaggtgtggcacctttaggacttggtctctttccatcttctacctctttcttctcagacaggcctgctctgtatggtagcaagatagtctctagccaagtttacatcctactaagcccctgtttatcttgaaaaaagagctggactcttttagagtctgaatagagcctctggattggcctggcttggtcatgttaatatccctaaacaatatagcataacaaagtagagtattacat

SEQ ID NO: 26890 - DNA, 456 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagggaaaggactacagagccccgaattaataccaatagaagggcaatgcttttagattaaaatgaaggtgacttaaacagcttaaagtttagtttaaaagttgtaggtgattaaaataatttgaaggcgatcttttaaaaaga

SEQ ID NO: 26891 - DNA, 241 bp, Homo sapiens
  misc_feature 241: n = A,T,C or G
ggctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccccctan

SEQ ID NO: 26892 - DNA, 277 bp, Homo sapiens
gcccttggaaaggtatctacggtggagtgtccttattctcaaagccctgtgtgccaactggtggacccagtgcatttctggcctagctaactctacacacagaatctcaggcaggaaacacttgacctagaagcctttcatttctaaaaagcaactgtaggtcgggcgcggtgactcacgcctgtaatcccagcactttgggaggccaaggcgggtggatcacgaggtcaggagatcaagaccatcctggctaacacgatggaacaccgtctctacc

SEQ ID NO: 26893 - DNA, 470 bp, Homo sapiens
ggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataatt

SEQ ID NO: 26894 - DNA, 468 bp, Homo sapiens
ggcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctg

SEQ ID NO: 26895 - DNA, 475 bp, Homo sapiens
  misc_feature 31: n = A,T,C or G
gaggccttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgatt

SEQ ID NO: 26896 - DNA, 337 bp, Homo sapiens
  misc_feature 6: n = A,T,C or G
gttgtnaaattatttcttaaatctagaaagaagttgaatttttgtatatggtcagtttggtgtgatttctcatgtatttttacattttatgaaactattgccttttataagttaaaatattcctttgttctattgattgattgattgattgattgagatagagtgtctcgctctgttgccctggctggagtgcagtggcacgatcttggttcactccaccttctgcctcccgggctgaggcgggagaatcgcttggacccggaaggcaaaggttgcagtgagccaagatcacgccattgtactccagcctgggcaacaagagcggaattccgtctca

SEQ ID NO: 26897 - DNA, 163 bp, Homo sapiens
catgcccctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgac

SEQ ID NO: 26898 - DNA, 222 bp, Homo sapiens
  misc_feature 20, 22, 83, 91, 143, 150, 173, 203, 209: n = A,T,C or G
atatatagacaacctaaagnantttaccaagaaaaacccttacaactgataaattcagtaaaatatcagaatataatattagnagtatttngatgcctccatgatgaaaaagctgaaaaagaaatcaggaagacaatcccatntacaatnattaaaagataaaatacctcggntctaatcaaaaaggcgaaaggggtctacangggaanctacaaaacacta

SEQ ID NO: 26899 - DNA, 486 bp, Homo sapiens
  misc_feature 5, 14, 29, 30, 434: n = A,T,C or G
ggtgngccctggcnctgagcggccgcggnnttggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacgggagagatacattcaaccacttgacaacctggttagaagatgcccgccagcattccaattccaacatggtcattatgcttattggaaataaaagtgatttagaatcttagaagagaagtaaaaaaagaagagggngaagctttttgcacgagaacatggactcatcttcatggaaacgtctgctaag

SEQ ID NO: 26900 - DNA, 485 bp, Homo sapiens
  misc_feature 1, 33, 103: n = A,T,C or G
nagttctttccagaagtactcatccagcacttntgcagggtccttagcaagaacccagcagagctgcaacttggtagggatcccaccctttccttgcaaagcncaatccaaactagaaggtgcaacctgggctctagctactcctccctggcagtcagcctgcccctgggactttgcacatgccatttgttctgcctggataactctttgccttcactgtccatcccctcacctctgacccctttagcagcttaacttctcttcttgcttcaggtctcagattcagcgcctctctgtttggaaaggcttgctgacctcccacgtccctgatcagagtctcttgcacttccaccagcacatccctgtgcacctcttggctctgctcttctttgagctggctgtattcttgggcaggccctttcttcagtggcaaaatgactgctggtgaccatgaatgcgtatccccagatgaaccacagggcctc

SEQ ID NO: 26901 - DNA, 114 bp, Homo sapiens
  misc_feature 15, 51, 57, 60, 65, 71, 103: n = A,T,C or G
cccctttgaaaatcncttgaacccaggtgggggaggttgcagtgagctganatcgcnccnttgcnctctancctgggcaataagagagaaactccttctcaancaaaacaaacc

SEQ ID NO: 26902 - DNA, 420 bp, Homo sapiens
  misc_feature 31: n = A,T,C or G
gaggccctgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaatttcaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagg

SEQ ID NO: 26903 - DNA, 430 bp, Homo sapiens
  misc_feature 7, 33: n = A,T,C or G
acagtcnttgcgttactttaagtactaagtttncaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtattt

SEQ ID NO: 26904 - DNA, 478 bp, Homo sapiens
  misc_feature 24: n = A,T,C or G
gtgtgtatatagtatgaatgcagnggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaaacccttgattatactctgttggacaaaccgagtgcaatgaatgatgcttttctgaaaatgaaatataacaagtgggtga

SEQ ID NO: 26905 - DNA, 109 bp, Homo sapiens
gtggctatttttaattgctttggatttgttaaatgttttctgtcttctgttaagtgtgttttctctggagatagaatgtaaaccatattaaaaggaaaaagtttcagac

SEQ ID NO: 26906 - DNA, 477 bp, Homo sapiens
  misc_feature 5, 28: n = A,T,C or G
gtcanagaactgggcaccaatccgctgnttagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctgacagagcataagtacatccaggttgtctaccttcataacaacaatatctctgtagttggatcaagtgacttctgcccacctggacacaacaccaaaaaggcttcttattcgggtgtgagtcttttcagcaacccggtccagtac

SEQ ID NO: 26907 - DNA, 462 bp, Homo sapiens
  misc_feature 30: n = A,T,C or G
tcaggctgaaagtgtaaaacttggaaattntgtgaactagcaaagctctagttagtctagtgctttttttcctcgttacttttactgccaatgttgtagtctttctgacaattacaaagactaaaaaattgccctttaatgaacagcccatacgatcttttctctctcttaaaactgtaggacttaaagcagcgtcttggccacaggttacagctcacagatctgttgatcaaaccagtgcagagaatcatgaagtatcagctgttactgaaggtgaggaggtggcgggacaaactctggtgtcaggagtgagtttgctgagaaaataagactcagttggggaaagaaggatttggtaggacaggggaatcacctgtgtaacaggtatattattttctggataagttaaaccttaaaaatttaaatcagctgttaactgaaggtgaggtggcgggacagact

SEQ ID NO: 26908 - DNA, 100 bp, Homo sapiens
ggggcactgccattttcgctatcacgggtaagcacgagcatattaaaggcgcttcttaatcggcgcgcgaagatggcgatcgagacggcgaagtaccaga

SEQ ID NO: 26909 - DNA, 459 bp, Homo sapiens
gggtgaggaaggtcaggtctaggaactcttactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgggcatcaggattttatggatgagcaaaaacgactaaagaagctccgtggaaaggagaaaccaaagaaaggagaagggaaaagagcagcaaaaaggaaatagtgttggtccctcaagagggagactttcttcctcagtggcggagagaagaaagtgcatttattgtctttccacatattggaggaatgtca

SEQ ID NO: 26910 - DNA, 381 bp, Homo sapiens
  misc_feature 6, 32: n = A,T,C or G
caatcncagtcactctaggactctgcactgtntggctgacctgacctgatgcccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattgggaaag

SEQ ID NO: 26911 - DNA, 468 bp, Homo sapiens
attgccccatggacataggagggcccgtgcaggaattcggtgtggacatagggccggtctgcttcttgtaaaaacctgaacccagaaacaacacaatccgttgcaaacccaaaggacccaagtactttccaatctcagtcactctaggactctgcactgaatggccgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtatttttta

SEQ ID NO: 26912 - DNA, 327 bp, Homo sapiens
  misc_feature 6, 31: n = A,T,C or G
atcatnaaaccttttctctaaatgtaagaanagcagaaaaaatcttataagattatcagatttttctaatgacacagaaatgtaagaaaaaatccctttatattgaaaaaagatgcagtcaaagtcttttcagacatgcccaaactttgagaattccttcaaccatctaatgctataaagatttttgttcttcctgttcacaaccagttgtataacagaaatactagctactgttttccttcctgtgtgtgaagtaatgaatcattgattatgtgacttgttatgtattcaattaaacactaaagaataaaacattcactcctttat

SEQ ID NO: 26913 - DNA, 478 bp, Homo sapiens
  misc_feature 17, 30, 45: n = A,T,C or G
tatggccgggattgcangtatacatccagnatgcacagaatgttncatttgtcccttattggtgatgctaattttgatcacttgggtaagatgtccagtttctccagtgtatcgttattgtttttccttttgcaattagtgggtaatttgtgaggagaaactttgagaccttgttgacaattctgttcctcatcaaatctacccctcctaggtttagcatcctttgacgattcttgtctgaataaatttttactaggatgtttccaaaattgtgattgttctaactccattattatttctgtattaattagtcatcattctactgtaaggaagaggtttccctttatcatcaacttcgagtaagtacttttttctgagccatttgaatattccttactagatgtggtgcctctttaccccaattacttaagtttgtatttccaaagaacaagggtgttttcctgcatagccatagcac

SEQ ID NO: 26914 - DNA, 154 bp, Homo sapiens
  misc_feature 3, 5, 27, 43, 44, 46: n = A,T,C or G
tgngnggccgggaagcacccctacagngtggacattcaataanntnttggcctttagtattatcaccagagcctcaaagaactaatcgttattaaaataatcattcatgcacataaatgctttatactcctagaaagcacaaatcaatttaaag

SEQ ID NO: 26915 - DNA, 127 bp, Homo sapiens
  misc_feature 55, 101: n = A,T,C or G
gatctcggggtccatctgtgatatttctttgtgccaaaaagaaaaaaaaaagagnggatcagtttgctaaatgaacattgaaattgaaatgctttatctgngttttctgtaaataaaagagtgcctt

SEQ ID NO: 26916 - DNA, 141 bp, Homo sapiens
gattcaaacacctggcgtcggccaacagcctcttccagaaaaaatcttccagtttacgctgtagatggaacatgtttctgtgaacctatcagtggatttcattctcttgagtaataaatcttatcttttcaaggcaccaac

SEQ ID NO: 26917 - DNA, 292 bp, Homo sapiens
  misc_feature 21, 31: n = A,T,C or G
gctttcacctcgttgcactgntgagagcatnatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaac

SEQ ID NO: 26918 - DNA, 127 bp, Homo sapiens
  misc_feature 7, 8, 28, 31, 34, 36, 48, 93, 115: n = A,T,C or G
ggctccnntcctctaggccgtcgctttnttntgntntcatcgcttcgncgaggcgccaatgtttgaggcagaaggccagcatgtccttcaggnaagaatgggaggcgaggagaanccgattggtgct

SEQ ID NO: 26919 - DNA, 450 bp, Homo sapiens
  misc_feature 7: n = A,T,C or G
aaagtgnagaaaccagtgttttgtcctgtagcattttccatgatctagattttgttgtttgtctgccatggtgtagtacaacttgttgctttatcctctgtatttcttgtaagttggtagttggatctagaggtttggttaaattcacattcaattttgttgttttggcaattacttcatgagtggtactgttgtctttcatcacagtgacagaatgtctgcttgtctctctcttttcgtgacatcagcagttattcatgctcaataactaggtgcttgattcatagggattatagtaagggttgcatttgaattctgtcattctttctttgtttcttagctagaatacctataaagaaaaacttctcttctcctggttagttactgagtggtatggttcatataagaaaagtaggataagatgctgaagtcttttccgttatttccagg

SEQ ID NO: 26920 - DNA, 261 bp, Homo sapiens
  misc_feature 1, 7: n = A,T,C or G
nctctcncaaatatttgttaaattgactgattgcatggtagataagcttgagggaatcacacaaggcaaaatagaaaaagaatgatctaaaaattattatgaagaagataatacatatgaaaaagaaaatagatataaattagtgttcctgaaaaaagagaacagaacaaatggattaaagacaatattaagatatttataaataaaagggaaaattttctggttgtaccactttattctagcctgggaaacagagcaaga

SEQ ID NO: 26921 - DNA, 499 bp, Homo sapiens
  misc_feature 23, 34: n = A,T,C or G
ccaaagcgcctgaggaccggcancatggtgcggncggggaataaggcagctgttgtgctgtgtatggacgtgggctttaccatgagtaactccattcctggtatagaatccccatttgaacaagcaaagaaggtgataaccattgtttgtacagcgacaggtgtttgcttgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatgggatgtgattcaacatgaaacaataggaaagaagtttgagaagaggcatattgaaatattcactgacctcagcagccgattcagcaaaaagtcagctggatattataattcatagcttgaagaaatgt

SEQ ID NO: 26922 - DNA, 486 bp, Homo sapiens
  misc_feature 59: n = A,T,C or G
gagtcaccagtcaagcaatcagttcctgattttttgttcattcaaaaggtgaagatgtngagaaacaaaaaaaagaaccgatgagtatttgtgacaagggtattctggtggagtcatccttcagtggtgaaatgttagaagatttggggtggctacaaaagaagagaagaataaaactctatcagaaaccagaaggagatcacattatcaaggttggaatttatcttttggaagctggcctagcaaaactagacttcttgagtgatgcaaattcaagaatgaaaaagttcaatcagctcatgaagaaagtaatggaaaagttacacaattctattattccagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctg

SEQ ID NO: 26923 - DNA, 182 bp, Homo sapiens
  misc_feature 5: n = A,T,C or G
gaganaccacagtagtacaaatgcagcagcaagttaattgtattagcagaatattgtcctcattgcatgtgtagtttgagcacagatcccaaaccttacggccaagtttcttctagtatgatggaaagtttcttttttctttgctctgaataaaactgaactgtgggttctctataagtgac

SEQ ID NO: 26924 - DNA, 135 bp, Homo sapiens
  misc_feature 5, 68, 71, 80, 118, 119: n = A,T,C or G
gtgtntgtctgtcacattatttagagagaagtaatcttgttaaaatgttttgtaaaaaacaaaaaagnatngtaaatagnctcgatattctgtgactcattattttcatgttaagagnntgtacatacatggttc

SEQ ID NO: 26925 - DNA, 476 bp, Homo sapiens
  misc_feature 24: n = A,T,C or G
tgactgcgtgggtctgtagcgccntcactgtaagaaagcaagatgcattttagaaactttaactacagttttagctccctgattgcctgtgtggcaaacagtgatatcttcagcgaaagtgaaaccagggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatga

SEQ ID NO: 26926 - DNA, 252 bp, Homo sapiens
  misc_feature 7: n = A,T,C or G
atgtatntgtgtgggtgtatatatatatatttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaag

SEQ ID NO: 26927 - DNA, 122 bp, Homo sapiens
  misc_feature 27, 32: n = A,T,C or G
gtaacacttatttcattttaaaaatcnacaantgaaaaatttaagggataattataaaagaaaaaactggccaggtgcggtggctcacgcctgtaatcccagcactttgggaggccgaggtg

SEQ ID NO: 26928 - DNA, 100 bp, Homo sapiens
  misc_feature 53, 70: n = A,T,C or G
gcactgccatttttgcttcatgggtaagcacggcatattaaaggtgctcttantcggcgcgcagaagatnttgatcgcgacggcggagtacctgcaccgt

SEQ ID NO: 26929 - DNA, 124 bp, Homo sapiens
  misc_feature 14, 66, 67, 97, 106: n = A,T,C or G
tatggccgggatgnaaccgagcttctattatgcctgtgtctaacacaggactttcttcactgcctnncatttaaaaagaaattaatgctcttaaganatatatttnacgtagggctgacaggac

SEQ ID NO: 26930 - DNA, 470 bp, Homo sapiens
  misc_feature 160: n = A,T,C or G
atacaacaaagtaaattgctaccttttgtatgctaatatgcaaagttttgtataatatgatggtttatttttagctctacacttaaaccataggtggttgagtgggaacttttgaaaactatcaagaggcttgttagacaaatttatattctgaaacctnaataagaaagcattccaggtttcaatccttgttttttgtcctgctcccaaattcttttttaagcccatagttcttgtgtcttatttgattcttctgctgtgcacattgtattggtccttgttgcatgtagtctactgtgtgttttccgattttataaggcagcatttctccatacaaaaagaaaaaaaatgatgtacatataaacgcttttgttgtatggctcctccatgttactgtatatatctgctagcacttcccagttacactcctgtgagtcagcttatttttaccctaacataaatagtatggt

SEQ ID NO: 26931 - DNA, 489 bp, Homo sapiens
ggctctcggcggcgattaggtggtttcctgttccgctatcttctttttcttcagcgaggcggccgagctgacgcaaacatgcagatctttgtgaagaccctcactggcaaaaccatcccccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcag

SEQ ID NO: 26932 - DNA, 273 bp, Homo sapiens
  misc_feature 7, 10, 20, 272: n = A,T,C or G
gatctcnagnaggagaaagnaggaatcctctttaattctttctatgaacccagtatcaccctaataccaaagccaggaaaagacacaacaaacaaggaaaactgcagaccaatattcctaatgaacataggtgcaaaaatcctcaacaaaattctagcaaaccagattcagcagtatatcaacaagataattcagcatcaagtgggtttcataccaggaatgcaaggatgatttgacatatgcaaatcaacaaatgtgattcaccacataant

SEQ ID NO: 26933 - DNA, 497 bp, Homo sapiens
  misc_feature 21, 28, 31, 70: n = A,T,C or G
cttggggcccgggacccccgncttttanggngggggacgccctaatttacactcacaacaccctgtgttnactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagcccctcgtagtaacagccattctcatccaaaccccctgaagcttcaccggcgcagtcattct

SEQ ID NO: 26934 - DNA, 116 bp, Homo sapiens
  misc_feature 2, 6, 57: n = A,T,C or G
gntgcncagatgacctgaggcgaggtgtttttgaccaacctggccaacattgcaaanccccgtctctactaaaaatgcaaaaattcgcctggggagcagagcgagactctgctacc

SEQ ID NO: 26935 - DNA, 476 bp, Homo sapiens
  misc_feature 41, 348, 401, 430: n = A,T,C or G
tatggccgggatgaaccttttaccacgaaattgccatatantatcttgtcttttttgggggtgtgaattttttgcattgttctgatcatattctttatcatgtaatttatgttcttttttactaagtattatgtgtggttattataggattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagtngcaaaaacatctctattttgcttatcttcctgctctcttgctgccttaggggnagtaacctgaacataaagtaacatgcttncaaataaaaaacctaaaccaaaaataagcaacctgatggaataggg

SEQ ID NO: 26936 - DNA, 100 bp, Homo sapiens
  misc_feature 5, 35, 59, 60, 66, 68, 70, 73, 78: n = A,T,C or G
aattntttgcttcgcgggtaagccgagcatacttngcaggtgcttccttagctccggcnngcgatnangnctnatcgngaatggcggaagttcctgcgcc

SEQ ID NO: 26937 - DNA, 100 bp, Homo sapiens
  misc_feature 19, 30, 50, 53, 57, 67, 68: n = A,T,C or G
gactcgagcaagcttatgnctgcggccganatttcgagctcacttggccnatntcgncctatagagnnttacgaatacttcttagatcggtgcgcgaaga

SEQ ID NO: 26938 - DNA, 141 bp, Homo sapiens
  misc_feature 2, 3, 19, 23, 26, 32, 38, 39, 44, 49, 51, 52, 56, 59, 68,69, 79, 87, 97, 112, 119, 122: n = A,T,C or G
cnncgcgggtaagcacgtntttnttngagggnttcttnntcggncgcgngnngatnttnatcgcgatnncggagtaccnccgccggntgggggggcnaccatttggcatacncagcttngcnatacggctgaggaaatccg

SEQ ID NO: 26939 - DNA, 490 bp, Homo sapiens
atcttcgcaggcaagcagctggaaggtggttgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgca

SEQ ID NO: 26940 - DNA, 303 bp, Homo sapiens
  misc_feature 33: n = A,T,C or G
aagagtcagtgcttcccaaggggaatgaatgtncgctcgctcactcactcactcctcactcactctttcagtcaacaaagagaactaccatatgctaagcactggtcatgcagatgtgggagttcctggtccctgccctcctggagagatgtaattgtttcacagtaatgataagtgtcgtgagagggggatgctcagaaacgatacctagcccagcccgttgagcagggaggatcaggagaggcttcttggaggaggtgccgccgtggctaagtcttataggatgactgggagttagccagg

SEQ ID NO: 26941 - DNA, 328 bp, Homo sapiens
  misc_feature 32: n = A,T,C or G
gacaaacttaaatactattttcgagtttaatntaccggcattctttttgaggaatccaaaggactctcccactcttaaaacgttatgtatttgtagcatttctaagatgtaaagaatataaagcagtgtgtgcagaccaaggtattaagagttttagtgatttactcaaggtcatccaattattcaaggaaagagaaaagtcaggtttttaaattttcaactgctcatgtttttgcaccattttgtgcatttctgtatataactttggaaaacatgatcctgattatgattcatcagggtgacttggcctatcacccatgccaattcc

SEQ ID NO: 26942 - DNA, 466 bp, Homo sapiens
  misc_feature 19, 32, 33: n = A,T,C or G
cattgcgggacgtcccagnacatcagggggtnntggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgacta

SEQ ID NO: 26943 - DNA, 136 bp, Homo sapiens
  misc_feature 6, 134, 136: n = A,T,C or G
gggtgnctgtaatcccagctatttggaaggctgaagcaggagaattgcttgagcctaggaggtggaggttgcagtgagccaagattgtgccactgccttcagcttgggcaacagagtaagactctgtctcacantn

SEQ ID NO: 26944 - DNA, 119 bp, Homo sapiens
gctgtagctgaggggaaaccccctgaagcccctaaaggcaagaagaaaaagtaaaagaccttggctcatagaaagtcactttaatagatagggacagtaataaataaatgtacaatctc

SEQ ID NO: 26945 - DNA, 147 bp, Homo sapiens
  misc_feature 31: n = A,T,C or G
agtcgcaaaataaacaacacagtcagatctnctgattctaggaatggtctaaattctacagaaggtgaagcccggggaaatggtacacagcctgttctctctggaacgggagaagaaactgttaggctaggtaagcaaagattacat

SEQ ID NO: 26946 - DNA, 356 bp, Homo sapiens
agttataaagtggtctgtcacctgccaaccttaaacattttccagttttagtttgtcattcaagttataagagtgttttggttgaattgagactgttaatgggtagcaggaggatcacttgagcccggaaggcagaggttgcagagagctgggatcgtggcactgcactccagtctggtgacacagcaagactacatctcaaaacaaaaaaacaaaaaaactttcatattctgtggttaacttggtttttaaagtgactttcagtgaaacaaaatcaggtacaaaatacagaaatatcagatagtttcagagcaatgttgcttttgaattttaaggttttccaaatgcagtcttga

SEQ ID NO: 26947 - DNA, 391 bp, Homo sapiens
ctggtaaaaagctggaagatggccctaaattcttgaagtctggtgatgctgccattgttgatatggttccgggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggaga

SEQ ID NO: 26948 - DNA, 490 bp, Homo sapiens
  misc_feature 5, 32, 56: n = A,T,C or G
atgancacagggacatctcaggctgactgttntgtcctgattgttgctgctggtgntggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttg

SEQ ID NO: 26949 - DNA, 255 bp, Homo sapiens
  misc_feature 86, 90, 135, 168, 204, 234: n = A,T,C or G
gtagttcgagggtgcgccgtgtccctttgcgttggtaccagcggcggcatgacggggtacactccggatgagaaactgcggctgcngcanctgcgagagctgagaaggcgatggcttgaaggaccaggagctganccctcgggagccggtgctgccccccacagaaanatggggcctatggagaaattctggaataaatttttnggagaataaatccccttggaggaaaatggnccatggggtatacaaaaaaga

SEQ ID NO: 26950 - DNA, 487 bp, Homo sapiens
  misc_feature 2, 58: n = A,T,C or G
gngccccggatatgaacagaaacttctcattttaagatgtttatgtggccaacaaacntgtgaaaaaaagctcctcatcactgttcattggagaaatggaaatcaaaaccattcttctttaagattgctttgtctattcttggcctttaaaattccatatgaattggaaccaaaaaaaaagcccgcattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgctgcaaatctacaactatctgatctttgacaaacccgacaaaaacaagcaatggggaaaggattccctgtttaataaacggtgctgggaaaactggctagccacatgtagaaagctgaaactggatccattccttatacctg

SEQ ID NO: 26951 - DNA, 481 bp, Homo sapiens
  misc_feature 33, 42: n = A,T,C or G
tatggccggggctctccaactaccctaaatttncaaatgttncttataacactatgaaaagatttgaccaacaatttacgtttgctgtgtgctttagtttttgtttaagcatattcttttgcttgaatttctgtgttcatgagagttagggtgttttatgcttcttgaactaattttataacatatttaatatattaccagttaagatataaaatcatttgtacatagcgaattgtaaagcagctattaaagtaggtgaaataaagtatatatttgccggttatccatatcttttagaagtcctgacagaacaaccagtttatttgcacataggtagcgtctgtttgaaggaaggtaaagttataaggaaactcaaatactataagatgtgtcaaggtatttctccagaattaattgcaaagctagtgctgaaggattttaatcagcttctaaaattttcttctcaataagacatatgttt

SEQ ID NO: 26952 - DNA, 244 bp, Homo sapiens
atttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgcgg

SEQ ID NO: 26953 - DNA, 356 bp, Homo sapiens
atatggaagggggcccaccctaatgacatcattttaactgaatcatccccataaagaccctgtctctaggcgaggcttggtggcacacgcctgtaatctcagccctttgggaggctgaggcgggaggatcaccagaggccaggggtttgagaccagcctggacaacatagcaagatcccatctctacaaaaaaatactaaaattagctggacatgatggtgaatgcctgtggtcccagcactttaagaagctgagacagacagatcgcttgagcctgggagtttgaggctacagtgagctatgatcatggcactgcattccagcctgggtgacagaacgacacccccatctctcat

SEQ ID NO: 26954 - DNA, 293 bp, Homo sapiens
  misc_feature 30: n = A,T,C or G
gctttcacctcgttgcactgctgagagcantatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacga

SEQ ID NO: 26955 - DNA, 115 bp, Homo sapiens
  misc_feature 30, 39, 60: n = A,T,C or G
atggcctgaaggaatccggccgcctcggcnagtcgactntagactcgagcaagcttatgnatgcggccgaaattcgagctcacttggccaattcgccctatagtgaggtcgtata

SEQ ID NO: 26956 - DNA, 100 bp, Homo sapiens
  misc_feature 13, 22, 30, 37, 56, 75, 92, 93: n = A,T,C or G
acacatgaagagnttattattnagagttcntaaccantttgctacctccttgaacnatgtcatcattctgcacangatgccaagcgtgacgnntgggtgc

SEQ ID NO: 26957 - DNA, 225 bp, Homo sapiens
  misc_feature 103, 106, 109: n = A,T,C or G
gaggccttgaggcagccagcgcaggggcttctgctgagggggcaggcggagcttgaggaaaccgcagataagtttttttctctttgaaagatagagattaatncanctncttaaaaaatatagtcaataggttactaagatattgcttagcgttaagtttttaacgtaattttaatagcttaagattttaagagaaaatatgaagacttagaagagtagcttggg

SEQ ID NO: 26958 - DNA, 221 bp, Homo sapiens
ggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccac

SEQ ID NO: 26959 - DNA, 472 bp, Homo sapiens
  misc_feature 6, 193, 252: n = A,T,C or G
aggggntttcttttttaaaataatgacctcctgacaggtgaggagtgatatcttgttgtggttttgatttccatttctctgacaattagtgatgttaggcatgttttatatgtctgttggccatttgtatgcatctttgtttttttttggagaagtgtctattcaagactttttcccattttttaaatttgtnactgagttgaataagttccttatatattttggatttcaatctcttatcagatatatggnttgcgaatattttctcccattccataggttggcttctgtctctggtgattgtttcctttgctgcaacagatgccttttagtttgttgtagtctcacttctctatttttgttttgttgcctatgcttttggtgtcatatccaggaaactactgccaagaacgatgttataaaggctttcctccatgttttcatctaggagttttatggtttcgggtcttgt

SEQ ID NO: 26960 - DNA, 500 bp, Homo sapiens
  misc_feature 7, 8: n = A,T,C or G
tctcggnnttatggccgagcgaggctggtaagtcacttcacttctctggattcctccacttgtaaaacatgagaagtgaactggatggtcctcccagcaactgcagtttcattctttatctttaaagaaatgtattttttaaaaaaaacaatgtgagaatgatgaaaagcttctcgctactcaatgtccttgccaatgatagtttgatagggaacctaaagttaatagctcccacagctctgactctttaaggaaattaagaggccagaaggcagcgttctaatcagatttgtgggtaagatggttatctatagtagttaatgatggatgaagtgcactgaggctcttaaaagatacttaggatttttgactttactctgtaggttctaaagtaaacatatatgaggtttttaatttctcagatactatacctgcagctctttttgctgactcaagatgatttttggtacctgttttatgccaacatgctccagccagac

SEQ ID NO: 26961 - DNA, 488 bp, Homo sapiens
  misc_feature 11, 417: n = A,T,C or G
gttgtcaaggnatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtgggagttggtgaatcggntgttctttcctcacatttggatgattgtcataaggtttttagcatgttcctccttttcttcaccctcccct

SEQ ID NO: 26962 - DNA, 482 bp, Homo sapiens
  misc_feature 31, 32: n = A,T,C or G
ggaggcccggacggcgcgcgtgcgtgctggnntgcgttcattttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaagagggaccatatgatgtgggtggttctaccaggaggtaatctgggcgcacagaatttatctgagtctgctgctgtgaaggagatacttgaaggagcaggaaaaccggaagggcctgatagccgccatctgtgcaggtcctactgctctgttggctcatgaaataggttttggaagtaaagttacaacacaccctcttgctaaagacaaaatga

SEQ ID NO: 26963 - DNA, 489 bp, Homo sapiens
  misc_feature 56: n = A,T,C or G
aatagcgacttgggggcactgcggcctctttgtggctctgaagataaagatgacanattatatttagtgagcacttaatacatgccaaataatttaactctcacaaaatggaataatctaagagctcttctactctttgtagatgaggaaagaggagcagaaggaagttaagtaatctgtccacatcacacagctactaaggggtggagccagaatggcatttcagcaacgtggctgaagaacatacgtgcatttgtttattaaaaagtgtttattgagcaccttctatatgcaaggccttgtacaataaaatggggataacactactaatatatgaataataaattgtcaataattatcaaatacccattgggttacaggcacggggtggtatatataataatagtaaaaataatgatgaaagtactgatgacagggataataatgtaaactacctggatgttttatatgtattatctcatggaagct

SEQ ID NO: 26964 - DNA, 335 bp, Homo sapiens
  misc_feature 7, 31, 147: n = A,T,C or G
agaatcngaagttcggatttgaagttggtcntgtttgttttcttggctaagattaagacaaagaacatatcaaatcaacagaaaatataccttggtgccaccaacccattttgtgccacatgcaagttttgaataaggatggtatangaaaacaacgctgcatatacaggtaccatttaggaaataccgatgcctttgtgggggcagaatcgcatggcaaaagctttgaaaatcataaagatataagttggtgtggctaagatggaaacagggctgattcttgattcccaattctcaactctccttttcctatttgaatttctttggtgctgtag

SEQ ID NO: 26965 - DNA, 431 bp, Homo sapiens
  misc_feature 6, 7, 31, 33: n = A,T,C or G
ggtcanngatgtccttcaccccgggaaggcnanagtgcctaagacagaaattcgggaaaaactagccaaaatgtacaagaccacaccggatgtcatctttgtatttggattcagaactcattttggtggtggcaagacaactggctttggcatgatttatgattccctggattgtgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggctactgtggatttttcgcaagaacattaataaactaaaaacttcatgcc

SEQ ID NO: 26966 - DNA, 292 bp, Homo sapiens
  misc_feature 2, 4: n = A,T,C or G
antncggttttttacggccgggggctcaccgcctgtaatcccagcactttgggatgccgaggcgggtggatcatctgaggtcgggagttcaggaccagcctgacccacatggggaagccctgtctctgctgggaatacaaaattagccggggtggtggcgcatgccagtaatcccagctgctcgggaggctgaggcaggagaatcgcttgaacgcggggggtggaggttgtggtgggctgatgtcgtgccattacactccagcctgggcaacaagagtgaaactccatccct

SEQ ID NO: 26967 - DNA, 128 bp, Homo sapiens
  misc_feature 4: n = A,T,C or G
agancttcagtacatttttattatcaggtttgtgacagtagatactgtgatgtattctggagatgtaaaatgtgtaagacatgttcattacacctggggaactgaagatacaaattcaattggtgggc

SEQ ID NO: 26968 - DNA, 471 bp, Homo sapiens
  misc_feature 33: n = A,T,C or G
atttcctagttttcttttgaataattaaaatcngtttgagagcccagtatttgtgaagtttgaatggcattagagggtcgccaattggcattgcttggtagttctactatttgtttcagtttttagttggggaatatttttgtattctgggagaagctgttctaaaatatgtcatccatttcacatttcccttcttaagctgatatttttatgcaatacaaaaataaataaataaaacacttactggggctacaggatggtcataacattggaaaattggccctcagccaaattaaccaggaagtggcaaggatatagacaattttttttcattctgaatttaatatctggctcattctttagcataaattttgcagtaaattgagttatattcattcaaaagaacctgatactatttcagcattctctttttatagactgctctgttctacaaatgtttgctctctaatt

SEQ ID NO: 26969 - DNA, 272 bp, Homo sapiens
catggtggctcacgcctgtaatcccagcactttgggaagctgaggcaggcggatcacctgaggtcaggagttagagaccagtgtgaccagtatggcaaaacccgtctctactaaaaatacgaaattagccaggcttagcggggcatgcctgtaatcccaactacttggcaggctgaggcaggacaatcgcttgaacccaggaggcagaggttgcagcgagccaagatcgcgccacggcactccagtctgggcaacaaagcgagactccgtct

SEQ ID NO: 26970 - DNA, 118 bp, Homo sapiens
  misc_feature 118: n = A,T,C or G
tgctgaagagagagacaaaagactggcggccaaacagagcagtgggtgaaatgggtccctgggtgacatgtcagatctttgtacgtaattaaaaatattgtggcaggattaatagccn

SEQ ID NO: 26971 - DNA, 162 bp, Homo sapiens
  misc_feature 31, 44: n = A,T,C or G
aggacccaaaagctaagggcaaaatgtactnttcttagaagaanaattggaagatagaacccaagatagaaaatgaaaatattgtcaagagtttcagatagaaaatgaaaaacaagctaagacaagtattggagaagtatagaagatagaaaaatataaagc

SEQ ID NO: 26972 - DNA, 286 bp, Homo sapiens
  misc_feature 33, 34, 58: n = A,T,C or G
aacaacactgaaatactaatagtaaaaaggctnncccatgtggctttgcagtgctgtncgtccagaagcatggcacacgatgcttgtgcatgtggaaacttagcggctgtcaacatacattctcagggatttatccaaaaaaattaaaaaaagaatgagagcatttattgtactgtatatatattatagtatatgtctgaatattgaaaatataacattaactaatttataaaaaatattctatgtaatgcaaaatacttgaagctgcagtagcttggttttaaac

SEQ ID NO: 26973 - DNA, 302 bp, Homo sapiens
  misc_feature 31: n = A,T,C or G
gaggccctgaggcagccagcgcaggggcttnttgctgagggggcaggcggagcttgaggaaaccgcagatatgtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtattc

SEQ ID NO: 26974 - DNA, 241 bp, Homo sapiens
  misc_feature 24: n = A,T,C or G
ccaggaggccctggtgtgagtggnggtagccctgcaggtggggctggaggtggaagcagtggtttaccaccatccaccaaaaagtcaggccagaagcctgtcttagatgttcatgcagaactagacagaattacacgaaaaccagttacagtttctcccacaacacctacatctcctacggaaggagaagcttcttgaagataccaaataaagccatttattctgttttctgggataatgt

SEQ ID NO: 26975 - DNA, 160 bp, Homo sapiens
caggaaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaac

SEQ ID NO: 26976 - DNA, 488 bp, Homo sapiens
  misc_feature 7: n = A,T,C or G
gaaggcncttgaggcagcccagcgcaggggcttttgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttg

SEQ ID NO: 26977 - DNA, 482 bp, Homo sapiens
  misc_feature 33: n = A,T,C or G
aatctcgcagtattcacatttgcaaaaatatantacttctgatcttctaggcaagtgataattcttttagatttgtgagaatatttttagatgacaaaaaaattggttgcacaagtgcatgaaaagccaatgattatgttatttgcaaaattacattccaccatgaaaatacaatgagatataagtttttctgaaaatgtagtagattccagtattgggttaagtcatttacattttatattattttatatccttgagggagttactattattttctccttttgaggaatttgatgttcaaatcggttacttgaccagtgtttcagtgccagtaactcatagcagctatactgtgaaaccaggcagtttgccatacctgccagctgtggacctgtgctcctagtaataataacaattaggcattatgccaaagattttatagtcacttaatctattattcattaaaatcctagaagctgata

SEQ ID NO: 26978 - DNA, 278 bp, Homo sapiens
  misc_feature 4, 5, 27, 30, 54: n = A,T,C or G
caannctgtatttgtttctttataatnttntctgctgaggaccttttgtctaanattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttt

SEQ ID NO: 26979 - DNA, 460 bp, Homo sapiens
  misc_feature 13: n = A,T,C or G
atctcatttaatnctttacaactctcttgcttggttccccggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttgg

SEQ ID NO: 26980 - DNA, 398 bp, Homo sapiens
  misc_feature 24: n = A,T,C or G
tgggagtatcgtggttagcttgcngcaactgctgtctgcatttatactgtttattgcatattcttttccctggaagtgaaagagaaatgtttttcttgttgcattgattacattttataaatttgcttagctggaaagtttgggaaaagaggcctgtttgtcaattgtacaaccgattgtgaagctctagtgtgaatatttttacgtctgtattagacattttctttgcaaatctattgttcgattgaaatgtaaatgaaattaaagatggtgtacacccatcatgtaaaaagcaggcaccatctctaagatggatttaatgctcatttttaaggcatatactcagcttctatttaaaactataatttaaaataattctgtacaatgaaatggggaat

SEQ ID NO: 26981 - DNA, 471 bp, Homo sapiens
  misc_feature 30, 32, 470: n = A,T,C or G
gattcttcccctctctacaaccctctctcntnagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgggtcttcctgtcctgcatcgccatgatgtgtaacgaattctttgaaggcttcccagataagcagcccaggaagaaatgaaaactcctctgatgtgggttggggggggtctgccagcttggggccctccctgtcgccagtgggcacttttttttttccaccctggctccttcana

SEQ ID NO: 26982 - DNA, 469 bp, Homo sapiens
  misc_feature 3, 59: n = A,T,C or G
canaacccttccactgtatgtttgaagagtttttccaagccagaatatggaatgttcangtatcctgaaatgggttcctgcatgtggtttcctgccaagcctaaacctgagaagaaaagatatttcctctttggaatgctgtgtggactctccttattcaatttaaatgttgctaaccttcctttcccactggctctgtataaaaaacttctggaccaaaagccatcattggaagatttaaaagaactcagtcctcggttggggaagagtttgcaagaagttctagatgatgctgctgatgacattggagatgcgctctgcatacgcttttctatacactgggaccaaaatgatgttgacttaattccaaatgggttctccatacctgtggaccaaaccaacaagagagactatgtttctaagtatattgattacattttcaacgtctctgtaaaagcagtttatgagg

SEQ ID NO: 26983 - DNA, 479 bp, Homo sapiens
  misc_feature 2, 6, 32: n = A,T,C or G
gnttcnccttttctctttagtgttctgtttgnaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccag

SEQ ID NO: 26984 - DNA, 481 bp, Homo sapiens
  misc_feature 17, 41: n = A,T,C or G
tatggccgggaaccatnccttatcttttctactcacttggntattcaagctattcaatgtgagttttaaaaagttaagcacagttagtgagtgaaatggtagaatgtagaacctttaagcttgctggttgataaacagaatcaatcttccaggacagataattccctgaagggacctatccttgcataagtgaactagttactcatacagaaaatgatctgcacatcttactacaacactacacacaagaactaaaagattaatgattatctgtattctcttcactaattactattatgggggaataatgattagcaaattatatgaattcgagttctctctatacttttattagtaaagcttatcatttaatggactgaagtaagatgtgttacctttattcgagctatttgtagccacactaaatgaaggtgtgtttgaatatggcgcatatatttgcatatgtcccatcattttcttg

SEQ ID NO: 26985 - DNA, 342 bp, Homo sapiens
  misc_feature 25: n = A,T,C or G
ctttattttttgatctttatttganattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaaga

SEQ ID NO: 26986 - DNA, 378 bp, Homo sapiens
  misc_feature 3, 31, 160, 231, 244: n = A,T,C or G
ganttcccgaggtatgaattttgtcttaatnttcttttccttttcattatagtttactaaatatgcatatttttctaaataacatgtttattatattgtttggttttgcttgcctttacttttatcattttttttttacttctggaatttgcttttttgngtacgacatccatttatatgtttagcagtaattcatttttacctctatatggcatttatccactttactgnggatgaacattgntggtttgctttctaatgtttttgctattatagtataagattctttattttttttgagatgaagtctccctctgctgcccgggatcgtgccactgcgctccggcctgggtggcagagagagactctgtctcaaac

SEQ ID NO: 26987 - DNA, 139 bp, Homo sapiens
tctaccccccctgccccaatatacctgtttagtagtgaagcaatttacaaagtaactccatgtgggggtgtacttttactctctactctcactacacatccaagaagcctcccctagacttttggttaatgtgttgttg

SEQ ID NO: 26988 - DNA, 100 bp, Homo sapiens
  misc_feature 3, 5, 14, 25, 30, 42, 59: n = A,T,C or G
aangngggaaagangagaaaattanagggnttcttaatcggngcgcgaagaatggtaanagagacggcggaagttcctgcgccggatggagaagcaagca

SEQ ID NO: 26989 - DNA, 100 bp, Homo sapiens
  misc_feature 18, 19, 47, 54, 63, 68, 70, 81: n = A,T,C or G
actcgagcaagcttatgnntgcggccgacattcgagctcacttggcnaattcgncctataganagtangnatacttcttanctcagcgcgagaagatatt

SEQ ID NO: 26990 - DNA, 273 bp, Homo sapiens
  misc_feature 3: n = A,T,C or G
tgnaggcgctcacacctgtaatctcagcatttttgggaggccgaggtgggcgaatcacaaggtcaggagattgaggccatcctgaccaacatggtgaaaccccgtctctactaaaaatacaaaaattagttgggcgtggtgggacatgcctctaatcccagctactggaggagctgaggcaggcaaatcacttgaaccagggagtcggaggttgcagtgagccgagatcgtgccaccgcactccatcctggcgacagagcaagactctgtctc

SEQ ID NO: 26991 - DNA, 488 bp, Homo sapiens
  misc_feature 2, 31, 34, 58, 59, 120, 294, 296, 305, 338, 360, 386, 398,425: n = A,T,C or G
anccacccaacactgtaggatacagctgtanttntaggtctttcccatatagaagccnntccataaaattggaagaaatgactgttatgtcagaggcacagatagtcacataaggatgcnagaaatatgaaaaaggaaacataacatctcaaagaagcacaataattctccagcaacagatccaatgaaaagaaaatctatgaaatacctgaaaaaaattcagaatgatgttattaaagaaactcagggagatacaagagaacacagataatgaatacaaaaaaaaaacaaaancnggaaaactnttcatgatctgaatgacaaattcaacagagatngacagcttaacaaagaaccaancacaaatcctggaagagaataaatcnttgaaataaatncaaaagataattgacagctttaacaanttggactagatcaagcaaaacaaagaatttctgaacctgaagactagtcttttaaaataatcc

SEQ ID NO: 26992 - DNA, 487 bp, Homo sapiens
  misc_feature 17, 35, 60: n = A,T,C or G
caaggccctaaaacagnatgtgtctgtatcttttntgtccctgtgtctgtgtatgattgntgtgccagactgaacatcctacccgtttaaattacctgtggtacttcagaaacctgctgccagtttgttagaatatttttaggttgacataagatcgtttgtttagcctttcagcagcttagcatttttggatttaatatcaggacttgaactgttgaacagtaacccctgaaaggccacgacaggttgttagtaacttgactgaagcactaattacaactgggcctaagctgggagactgtctcctaagaactagacactcatggagtgaatggctaagtgagcctagccaaccacttaacgtttcaacctcaagttggttttattatcctctgcttaatttataaatagtaactcctgagctgctaaagactttattcctttgtgaaaaatactctagagaagaaaggcaattattagtgctatt

SEQ ID NO: 26993 - DNA, 498 bp, Homo sapiens
gacttacggtgtccattattatgccgtaaaggataagcaaggacttccttggtggcttggaataagctataagggaattggccaatatgatatacaagacaaggtgaagcctcggaagttattccaatggaaacagctggagaacttatatttccgtgagaaaaaatttgctgttgaagttcatgatccacgaaggatttcagtttcaagaagaacctttgggcaaagtggcctgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccgagctggtgacactggaggcgaaaagtcagttcatcatggcaagtaatggcagtttaatctcctcaggttctcaagactcagaagttag

SEQ ID NO: 26994 - DNA, 225 bp, Homo sapiens
  misc_feature 2: n = A,T,C or G
anctccccaactactggcaatttgtaaagatttttatatgatatataaatgtgattgccgcttttcaatgttagccacagtgtattttttcacttgtactaaaattgtatcaaatgtgacattatatgcactagcaataaatgctaattgtttcatggtataaacgtcctactgtatgtgggaatttatttacctgaaataaaattcattagttgttagtgatgg

SEQ ID NO: 26995 - DNA, 468 bp, Homo sapiens
  misc_feature 8, 22, 33, 40: n = A,T,C or G
gaagcatngttggaaacggagnactgtctgacntcaaagnaaaggaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgcttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttattttttttaccaattccaatttc

SEQ ID NO: 26996 - DNA, 114 bp, Homo sapiens
  misc_feature 36, 40, 83, 84: n = A,T,C or G
atgaggacaggggacctttgctatgccccataaccngtangagaaatccccctgcctgtggccggcttcgtaaatctagctanntgcagcttgcgtgcaatctcctgaacgctt

SEQ ID NO: 26997 - DNA, 461 bp, Homo sapiens
  misc_feature 6, 30: n = A,T,C or G
gcaggncatggaatagagccttggaatggntattctttagtattcctgttctcacattttcatcatcaccattttggttagcttcaaaagatcctacaaggtttttcttctactaacaaggctgttccccagtttcattcttataatcttgtgatatggattttcatagacaagtgggccagatttttaacattttaaaaacattattaatctttgatcatatccagcaagaatgaacttgttctggagatttcttctacagtgggcatcacattttaaaaatgtttggcttgtcatggggattatggtggggggtgatactggtacctatttctgattataaacttatgggaccatatgaaccagaagattaagaaggatagcttttctgagctgtatagcacccttgtgtttacattttctggaggaaaggaaagctgctttgttttattaaggaatga

SEQ ID NO: 26998 - DNA, 295 bp, Homo sapiens
caaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtgga

SEQ ID NO: 26999 - DNA, 461 bp, Homo sapiens
  misc_feature 7, 33: n = A,T,C or G
aatttcnctataaaatgctttagtacttggagntctattattttttttaaaagatgggcccaaaatcagtaattatgagagttattattcaggttcacagcagtgcagcagctatttttcacttgataattaccttgttaaactaatgtcagaccagcgccatgccttatttaagaaaatggtccaccagccccgagtaagcaggcccagctgtagaaatattaaaagatttattaaattcaggctcgtcttcagcattgtctcatcgacattagttatgggacttgtaagaagttttctatttctcattagatgtttgcagcatcattcttgaggtcctgctgcagcttccgacagctggtgtttccattgtgttccttctatttctagttctgggctttgtggccaaccagggcaccttttaattggcacaatcttcattcagaaccctgaggagaaga

SEQ ID NO: 27000 - DNA, 257 bp, Homo sapiens
gtaatcccagcaccttggaaggccaatgagagtggatcatgttgaggccgggagtttgagaccggcctggccaacatggtgaaatgccgtctctactaagaatacaaaaatgagccgggcgcggtggcacgcacctgtggtcccaggtactccgaaggatgaggcaggataattgtttgaactcaggaggtggaggttgcagtgagccaaaaatcatgccactgccctccagcctgggtgacagagtgagtctctgt

SEQ ID NO: 27001 - DNA, 470 bp, Homo sapiens
cgttaatatcgccccactccgcgcctgggacgatttcttcccgggttccgatcgctttgcccggccggacttcagggacatttccaaatggaacaaccgcgtggtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaaga

SEQ ID NO: 27002 - DNA, 469 bp, Homo sapiens
  misc_feature 6, 29: n = A,T,C or G
ggaccnttctttatccgctggctcaggcnttagaaggagaaggggcaacctacccaaggcagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcatt

SEQ ID NO: 27003 - DNA, 322 bp, Homo sapiens
  misc_feature 126, 154, 297: n = A,T,C or G
gactattacaaataaagttgctatgatcctttatgtacacgttattatatggacaaaaactttcatttctcttaggtaaaaactcagcagtggaatggaagggatagtatgacaggtgtgtatgtncaacttcttaagaaaccaccaaactgtnttccaaaatagtatcattttacatttctaccagcagtgtatgagagttctagtacctccacatccttgccaacacttgttactctgattcttcctaattttagctgtcttagtgggtatgtaatagtatcccattatagtttngatttacattttataatgattaatg

SEQ ID NO: 27004 - DNA, 336 bp, Homo sapiens
  misc_feature 13, 32: n = A,T,C or G
gctcttccggggnacgttgtctgcaggcactnagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcaga

SEQ ID NO: 27005 - DNA, 259 bp, Homo sapiens
gtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattc

SEQ ID NO: 27006 - DNA, 397 bp, Homo sapiens
  misc_feature 30: n = A,T,C or G
tatcgcatatagctatcctctgtaaagaanatggatatctgaggttttttacttctgaaatactaggctgttaaagcttactgagatttttactttctattagtgatagcagtacctttttcatgtctatgggctatatttccatgtatatgtccacaaagtacctgcagttctttgattttgatttttgcattttctttactgtttcatgtggactatgggctgtaagctgcttacattgaatctttcagttttgcttctgtctgaatttgtctagatgaaaaatactagactggctcatatgaaatgataaaattgtagaccagggtagcaaactatggcctgtgggcctgatactgtttaagaaggtttttcacatttacaaaggttttttttt

SEQ ID NO: 27007 - DNA, 127 bp, Homo sapiens
  misc_feature 7: n = A,T,C or G
tcatccngctaggactactattcctaaatggcttcaaagaggagtcatggatccactggacaaggttctgtcagttcttatcaaaaagctcggtactgcactacaggatgaaaaggaaaagaaaggc

SEQ ID NO: 27008 - DNA, 465 bp, Homo sapiens
cagcacaagccctggaagagtgtgaagatgatggtaaggggccaggcaggtcttgggttaagtgaattgggggcactgttcacatgtgcaaattttaaagagtcgtagccaggtcagtcgggtcttatgttgagtttttaaaaggtaatccaatttctgctaaatggactgtggtttacaaaagcaggaagaaagtcagagttgtttcaagagaagaatttgtttacacataaagacagatgcttactaatatctccattagaagcagaacagtcagaaactgttcaaatgaagatacgtcctctgtcttcaggaacttagagtaaattctagaaagtctctaggaataaagaaaccaaagacggtctggtcagtcacacattctcaggtttaaccctatcttataaaagtcttaggaggaaaagttggggagttttttcttgaactgtacatatttcacatact

SEQ ID NO: 27009 - DNA, 177 bp, Homo sapiens
  misc_feature 31: n = A,T,C or G
gacattgccggcgtcttggcgattcggcccnacgagctccgctttcgctacagcatggtggcctactggagacaggctggactcagctacatccgatactcccagatctgtgcaaaagcagtgagagatgcactgaagacagaattcaaagcaaatgctgagaagacttctggcagc

SEQ ID NO: 27010 - DNA, 446 bp, Homo sapiens
  misc_feature 27: n = A,T,C or G
gggcagctgctgaccaaaccccacagnaacagagggcaccaggcatcacacgacatctttccctcccatctctgccatctgtctgtctggcaatggaaggagcttcagcaggaggtccttcccagaaggttgattcttggcctgggtggtagaggagatatcctgaccctaaagtcttccagccccgggtcatcctctcctatactagggcctattgaccgtagaggccaggtgcggtggctcatacctgtaatcccagcagttggggaggccaaggtgggaggattgcttgagcccaagagttggagaccagcctgggcaacatggtgagaccaattgactgtagggcttgtcccttgctaagacaggagcagaagactggatggctgtgtcctcaaggcagtcccctcccatccccattcccaaagtcagaaagtgaagccaga

SEQ ID NO: 27011 - DNA, 471 bp, Homo sapiens
  misc_feature 26: n = A,T,C or G
gcttttttttcaggcggccgggaagnaggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaaacatgtctgtacacctgtccccctgcttcagggacgtccagatcggtgacatcgtcacagtgggcgagtgccggcctctgagcaagacagtgcgcttcaacgtgctcaaggtcaccaaggctg

SEQ ID NO: 27012 - DNA, 110 bp, Homo sapiens
gtctgcgcgcggggcaaggggctccacgacaaaaggacaagatttgacttaaattaagtttttcccttgaggatattttcattttttttaaaagaatataattttcttct

SEQ ID NO: 27013 - DNA, 395 bp, Homo sapiens
ggaggctgaggcgggagaattgattgagcctgggaggcggaggtggtagtgggccgagatcgcgccactgtaccactccagcctggcgacagagcgagactccgtctcaaaaaagaaaaacagtatgtatactaggttacattttctgaaaagaaaaacaatatatggtgtgtatttatatgttcttagaaatgaatgtatctatatgttctatatgttcatatggtacatatctataaggatatgtatcaaaacgtttatagggctcatttctaggttgtgggatgacaagtaatttttccctttttgttctctagtctttagtataaccataactgctgtatcaaattgttttctaataattcgcattattattggattaaatgtaccataac

SEQ ID NO: 27014 - DNA, 445 bp, Homo sapiens
ggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaaggcttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatct

SEQ ID NO: 27015 - DNA, 383 bp, Homo sapiens
  misc_feature 4: n = A,T,C or G
aagnaagggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgaggaaactgcgagccagcattacccccgggaccattctgatcatcctcactggacgccacaggggcaagagggtggttttcct

SEQ ID NO: 27016 - DNA, 469 bp, Homo sapiens
aacttacaaataacatacatcccttaaaaaaattggcaaaatgatgtttgatgatgcttgagtttggatgttttaattatgccagttaccttttgaggaactagctttagcttctcttacacgacatagtattcgtccattcgctaacgtagatacaattagtagagctaactcctcgtaacttttttctaacctggaagtcacctgtaataccctcctttttctttgcgctcttttaccccagggtacaaagctcattggatcactcaagccaatggagcttagacctgaaacttttcagggaaaaatagggcaatagtcacgataagtaagttccctttttaaatgactggacacattagtctgactgactttcatcatacatgaaagttactttgttttactgtttgaagcaagagtgagcatgccctgaaagataattcactgtctggaagcctgtttttgattt

SEQ ID NO: 27017 - DNA, 480 bp, Homo sapiens
ccttatggccggggattgcaataaaagtaaaaattgacatgtgggatcaaattaaactaaaaagcttcttcataaggaaagaaactaccaacagagtaaaaggaaagaaaatgtttgcaaactatgcacctgacaaagttctaatatccagaatctatactgaacttaaatcaacaaattacaaaaaatatcccttttaaaaagtgggcaaagaacttgaacagacactgctcaaaagaaaatatacaaggaagccaacaaacataagaaaaaatgctcatcactaatcatcagagaaatgcatataaaaattactatgagataccatctcacatcattcaaaaaggctactaaataaaaagtcagaaataaaacagatgatactggcaaggctgtggagaaaagagaattcacagttggtggaaataaaaattagttcaactactgtggagcacagtctggagattcctcaaagagcat

SEQ ID NO: 27018 - DNA, 376 bp, Homo sapiens
  misc_feature 21: n = A,T,C or G
tatggccgggcttcacaagangacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccctaaatggaaaactgtttttagaaaatatgatgatttttgattgcttttgtatttaattctgcaggtgttcaagtcttaaaaaataaagatttataacagaaccca

SEQ ID NO: 27019 - DNA, 100 bp, Homo sapiens
  misc_feature 21, 53, 57, 59, 64, 76, 80, 93: n = A,T,C or G
ttgctgggaagaggccatttntcaggtacgacgaactgctacgaagaaatacngatnanaaagncacgcctgaaanagcntgtgaaaacccanattgtac

SEQ ID NO: 27020 - DNA, 224 bp, Homo sapiens
  misc_feature 224: n = A,T,C or G
ataacagttgaatatcagtggcattttacgtatgtattcaaggttgttttgttttgtaaaaatatgtggtttttctgtcttaacagcattcactttttacgttgctacgtgtgggtttcttttctttttttcttttaatatttctttctttccaacacaggaatactctgaagatagtaactccgagccaaatgtggatttggaaaatcagtactataattccn

SEQ ID NO: 27021 - DNA, 244 bp, Homo sapiens
  misc_feature 7, 8, 38, 124: n = A,T,C or G
ctcggcnnttatggcccggggaggcattgaggcagccnagcgccggggcttctgctgagggggcaggcggagcttgaggaacccgcagataagtttttttctctttgaaagatagagattaatncaactacttaaaaaatatagtcaataggttactaagatattgcttagcgttaagtttttaacgtaattttaatagcttaagattttaagagaaaatatgaagacttagaagagtagcatg

SEQ ID NO: 27022 - DNA, 171 bp, Homo sapiens
  misc_feature 14, 170, 171: n = A,T,C or G
gggcctgagcagangtggcagtgcacagtggttctagggagtggcaagtaatgaagtgtggccagatttcaggttggtctatggcatttgatggtagaatggggcatgaagacaggcaggagccagtgaagagctgaaggtggctggaatcagatactatgcagaacgcnn

SEQ ID NO: 27023 - DNA, 475 bp, Homo sapiens
  misc_feature 19, 376, 416, 449, 466: n = A,T,C or G
gcttctttttgaggaagangcggtcgtaagggctgaggatttttggtccgcacgctcctgctcctgactcaccgctgttcgctctcgccgaggaacaagtcggtcaggaagcccgcgcgcagcagccatggcttttaaggataccggaagaacacccgtggagccggaggtggcaattcaccgaattcgaatcaccctaacaagccgcaacgtaaaatccttggaaaaggtgtgtgctgactttgataagaggcgcaaaagaaaagaatctcaaagtgaaaggaccagttcgaatgcctaccaagactttgagaatcactacaagaaaaactccttgtggtgaaggttctaagacgtgggatcgtttccagatganaattcacaagcgactcattgacttgcacagtccttctganattgttaagcagattacttccatcagtattganccaggagttgagggggnaagtcacca

SEQ ID NO: 27024 - DNA, 137 bp, Homo sapiens
  misc_feature 6, 7, 27, 42, 52, 53, 65, 88: n = A,T,C or G
tcggcnnttatggcccgggatgagaancacagtgttgtcctntccttttatnntagccaggaagnttctattatcctgatggtagagncagactccaggcagccctggacttgctagcccaaagaaggaggatgtgg

SEQ ID NO: 27025 - DNA, 481 bp, Homo sapiens
  misc_feature 435: n = A,T,C or G
gttcttctttttcttcgcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtgacattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaaggtggntctttctttgaagggcagcctcctgcccaggccccgtggccctgga

SEQ ID NO: 27026 - DNA, 316 bp, Homo sapiens
  misc_feature 2, 19, 47, 56, 69, 241: n = A,T,C or G
tncccgggaatctccggcntttattggcccggggcgcttgcccgccntggcttccntgtgaaaaaagcnttgtggcgaaggggggcaaaaaaaagaagccaagttctgaagttcccttctttgattgccccccccctgtagaaagatggaatcatggatgctgccaattttgagcagtttttgcaagaaaggatcaaagtgaacggaaaggctgggaaccttggtggaggggtggtgcccntcgaaaggagcaagagcaagatcacccgtgacatccgaggtgcctttctccaaaaggtgtttgaaatatctcacc

SEQ ID NO: 27027 - DNA, 108 bp, Homo sapiens
  misc_feature 2, 7, 24, 33, 35, 53, 57, 61, 66, 104: n = A,T,C or G
antggcncgggggagctttccccntcttgggancnaaaggagtgtccttttancccntccngcccntccaggcttctggcagaaaataaacctcccaccccganctgg

SEQ ID NO: 27028 - DNA, 138 bp, Homo sapiens
aaatttaaatatcctgtgagctgatgaaatgagtgcaaccctttgtttcctgaaaaccaagttggattctttgggaagacttgataaaaggtgagtcattaaaataatgactgtagaattagatatggctgaaataac

SEQ ID NO: 27029 - DNA, 475 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatataca

SEQ ID NO: 27030 - DNA, 263 bp, Homo sapiens
  misc_feature 262: n = A,T,C or G
tgcagtgggtcacgcttgtaatcccagtactttgggaggctgaggcaggaggatcacttgaagccaagagtttgagacaagcctgggcaacacggtgagacctagtctctacaaaaaatacaaaaattagccgagcatggtggcgtgtgcctgcagctccacctacctgggaggccgaggcgggagaaactcttgagcccgggaggtggaggctgcagtgggcagtgttcacagcctggctgacagagcaagactcctgtcnt

SEQ ID NO: 27031 - DNA, 179 bp, Homo sapiens
  misc_feature 175: n = A,T,C or G
aggaaaggaatttacgtacttcaccccacctgcttacattttctttctgctcactcactgggaactagagataacaaggaaacacaaaacctagatagttctgaatcttaaatgcaactctcagaaatcagctcccttgataacattgattgcagttagttccataagggagggnttgc

SEQ ID NO: 27032 - DNA, 488 bp, Homo sapiens
  misc_feature 7, 8, 51, 60: n = A,T,C or G
atagtcnntgatatctaaggagttggcaagcttaacaaaacccttttttanaaatgtccntcctcctgctttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttattagtttacaatgaatgcactgcataaaaactttgtagcttcattattgtaaaacatattcaagatcctacagtaagagtgaaacattcacaaagatttgcgttaatgaagactacacagaaaacctttctaggga

SEQ ID NO: 27033 - DNA, 100 bp, Homo sapiens
  misc_feature 3, 7, 18, 22, 25, 34, 36, 40, 42, 45, 46, 52, 54, 59, 64,65, 78, 80, 82, 84, 87, 99: n = A,T,C or G
tcnttangatccggggcnggcnggngttcctttnangaangngcnntgtctnanaccanctganntatgcatggcctngnananagnagctgctatctng

SEQ ID NO: 27034 - DNA, 266 bp, Homo sapiens
  misc_feature 4, 6, 57, 195, 225, 248: n = A,T,C or G
agancncagtggaataaaactgtaaatcaactccaaaagggaaaccctacaaaaccntgcaatacatgaaaattaacctgcttttgggtcaaaaatgaaatcaagatggaaatttaaaagttctttgaactgaatgacagtaataacacaacctatcaaaacctctgggatacggcaaaggcggggctaagaggnaagttcatagcccttaatgcctacagagcncaacagacatttttaaggccccnccttaagggaacttgggg

SEQ ID NO: 27035 - DNA, 480 bp, Homo sapiens
cattgcaagtttgctgagctgaaggaaaagattgatcgccgttctggtaaaaagctggaagatggccctaaattcctgaagtctggtgatgctgccattgttgatatggttcctggcaagtccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttt

SEQ ID NO: 27036 - DNA, 480 bp, Homo sapiens
caactaatgaatctaggaaatgatcctcaattactgcccatacaattaaatgaaaggttgatggagaatttttataagatgaattaggatgagaagaacaaaacctactaattagcaaaagaaagacagcagaaattactcaccttctgatgtgatatagaagtacaaccccactcatgaaatatacttgccaaaaaataggacatgtatctgttcaaacctctaggtctacccattttcaagaaactcagaagaaagaggaagatgtcacatgacaccatggaaaccaatcagcaaaatccaaaatgtaagacattctacaggacaaatgactgaaataagtggcaaaagataaaaaagtgggaggactatcaaaaaattaattaacagattaaaataaattaataccttaaagacatttcatccagatagtctggatctttgatttgaacaaagcaactttgtaaaaaagaactttga

SEQ ID NO: 27037 - DNA, 487 bp, Homo sapiens
  misc_feature 2: n = A,T,C or G
antaatggagcaattcagtaaggaaaattttggggggcattttaatgtcttcttccgtttgacacttaaattgcttgtcctgtaggatatcccggatttattaccattttcttgaaaactttacttgaacatttttccattcatgtgaaagcttagtcagagtgcttcatagctgtattacatgaacttcttaaactttccttaatgtggatgttaagaaagtgaagatttaataaaaagaaattcagatatttttaaaataaagggatatcttatatacatttatttgaaattgattttcctgacaaaggccatcactgaatactgaactcgttaatgggctttttattaggtctaagtgctttcctatcatttctcagccatgcaacacagtgagataaaactggtggagtctctgcatctgcatgtaaaatgatagagaacagagagtaatcacataaagaagctaacaagaaaaagcctttac

SEQ ID NO: 27038 - DNA, 312 bp, Homo sapiens
  misc_feature 2, 10, 41: n = A,T,C or G
anctcggccntttatggcccggggaggcattgaggcagccngcgcaggggcttctgctgagggggcaggcggagcttgaggaaacccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagt

SEQ ID NO: 27039 - DNA, 471 bp, Homo sapiens
attacaaataatattactctatgatgattgcttccacccacacgactgcaacatacaggtgccttggggaaatgtggagaacattcaatcttgccgtcactattcatcaatgaagattagcactgagatccagagaggctggatgacttgctcaagttcaccagcatggtagtggcaaagagaggtccagagtcctggcccttgatgcccagctcagtgccacaaagctcagtaggagggatgttccagtggatgagggccaccaggaagcacaggtccaaggctggtcccacacttatcagcagcaacaactgtcagttcatcctgcatgggaaaaatgttggaatggggaagtctgaaatggggctactgttttcagtcctaacgtgctgtgtgacattgggacaacactttccctctctggacctcagtttccctctgtatacaaggatcagattcttgctgtgaccc

SEQ ID NO: 27040 - DNA, 480 bp, Homo sapiens
ctgtttatttatgacctaattgtgattcttttattaataaaagctaatgggaaaaggacccctgattaagctgatgactagacctacaattaattttcctgcagtatatgaagtattgtaccagagtattaaaagatatgtaatattttattgataaatctatcctttaaaaggaatacgttttaggatgtcatcattttgatgtgaatcatgtaaatgttgataatatgctgtttattatacatttagtgtttcaagagattcacttaattgcctttttgcccacgtatattatgtagtctatttgcaactgttcttaaaaaaatgacattaaaagaatagtttatgtaggagaaacattagtggatgttaattgtctccccacctatatttatgggtgttagcgcaactgctttgctagttgcaaagctgtattatcagagtaaaagtgtatttgtaaactgtatgggaactaaaaat

SEQ ID NO: 27041 - DNA, 115 bp, Homo sapiens
tatggccgggattgtcaggttaatttttataagtttttagatgttttgaacgaaaatatgaaaaccctgcagaagtgtttatcctttactgttaacaggatgtcatcttgaacac

SEQ ID NO: 27042 - DNA, 381 bp, Homo sapiens
aattacattggtagcttctaagtaagaacttcagtaaataacaactttttaaatctttttacctctaaatctggcttaataacatgaccagattaaagcataaatgcatgtgctactttttattaagctaaagcagtggttctcaagtgtggttcctggactgcagcatcaacatcacctggaaacttgttgaagtgcatgttctcagacacttccctagacctactgcgtcagaacctctaggaatacgacctggcaatctgtgatcgtggctcactacagcgtcaacctcccaggctcaagcaatcctcccacttcagcctcccaagtcgtggggactattagaatggcaacatacttgtttaacattgaattctgtgc

SEQ ID NO: 27043 - DNA, 136 bp, Homo sapiens
  misc_feature 19: n = A,T,C or G
acagtgtggccgagcaganggctatgtgctagagggcaaagagttggagttctatcttaggaaaatcaaggcccgcaaaggcaaataaatccttgttttgccttcacccatgtaataaaggtgtttattgttttgt

SEQ ID NO: 27044 - DNA, 241 bp, Homo sapiens
  misc_feature 4, 11, 33, 47, 88, 90, 118, 129, 138, 154: n = A,T,C or G
aaantcggccntttatggcccgggggtgccagngatgattttcctantctgcaaaatagtgtatttcctggattacacatagtatggntncctgagtattctgataaatgtgtttttnaaaacctcaanatacttttnagaaaaaggagcatcnggatatgcataaagcagagctaaaactaaatttctttcatgtcctccctacttcctcagtgtcaatcagattaaagtgtgtaatcct

SEQ ID NO: 27045 - DNA, 471 bp, Homo sapiens
caggatgctagaggtgaatatttgggtcattttacatgtacactacatagcaagttgatactcatgttgcatgttcttttaaattagtgattttgtgtcttaagtctttaacttccaatacttcatcatgtatgtaacccttccatgtttgcttctgataaatggaaatgtaggttcacttgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggaggggaagatgggaaacaaaatagagaattcttaagaattttgtttaaaccaaatgtttcatgtagaatgcaaaaatgttggcacgtcaaaaatatg

SEQ ID NO: 27046 - DNA, 306 bp, Homo sapiens
  misc_feature 6, 7, 28, 35, 61, 65, 306: n = A,T,C or G
tcggcnntttatggcccgggggaaaaanctggaanaccagaagtaccgggaaggcgatganagantagagaagatagggaaattagaagataaaaacattaccttttagaagaaaaaagataaatttaaaccctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtttn

SEQ ID NO: 27047 - DNA, 468 bp, Homo sapiens
ggaggctgaggcaggagaatcacttgaacctgggaagcaggggttgcagtgagccgcgatcgcgccattgcactccagcctgggcaacaagagggaaacttcatctcaaaaaacaaaaaaacaaaaacaacaacaaataaaacaaattttctaaaatgtagtaattttaaaccctttcaacttctatgtattgaatagcattgttattggaacgaattttatttttaatagtgatttatatatattttattaatacaactagtacagatgttgggggctgaatgtatttcatacacaatttgtgatgtttacatgtaagtaagtattgatatatagattaaaagcttatcaatttccctgggagatacccagtgggcagcattcctggaacccagttttagactgaagatcccctcactgcagtacaactaaattaaagttacacgaaattactgcaagaaaatgtag

SEQ ID NO: 27048 - DNA, 455 bp, Homo sapiens
  misc_feature 1, 15, 121, 149, 157, 160, 276, 426: n = A,T,C or G
ngttagtgtacaacnattgatgtttgttttctgtttgattttaaacagagaaaaaataaaagggggtaatagctccttttttcttctttcttttttttttcatttcaaaattgctgccagngttttcaatgatggacaacagagggatntgctgtanagngttttattgcctagttgacaaagctgcttttgaatgctgggggttctattcctttgacactacgcacttttataatacatgttaatgctatatgacaaaatgctctgattcctagngccaaaggttcaattcagtgtatataactgaacacactcacccatttgtgcttttgttttttttttatggggcttaaagtaaagagcccatcctttgcaagtcatccatgttgttacttaggcattttatcttggctcaaattgttgaanaatgggggcttgttcatgggtttgggatt

SEQ ID NO: 27049 - DNA, 468 bp, Homo sapiens
tacctcattggatgttgaaagtttaaaagaatgcctgattcaatagtcagtatttcatacatattagctattatgaacaaaccactctgcgtacagttaaaagaatttgtcaggcatggtggctcatgaccgtagtcccagctactcagagcctggggcgggaggatcacttgagcccaggagctagagtcccacctgggcaacatggggaaactttgtctctaaaaataaatacataaataaaagaacctggagtcttgaagagactaagtgactttatccctagtcacatcaatttggaagtagcacagatacgatgttcgtcagctagccaacagatatacactgagtgccccccatgtgccagggtttttctagcgtctggagatagaatggtaatgaaggcaggtgagctttgctgagaaatacagtacagtcattttctgagacctagtccagtaagtcctt

SEQ ID NO: 27050 - DNA, 473 bp, Homo sapiens
actgtggttacattatgtgcacagggaagggggtgtcatttgtggggagatgtgattgttttagtcaaatgatgcaaaagagatgttaacacaggcaaatttcatctctttaggggatccctctctcaccccttactcctaaaataaaaagaaattgtagatattggtatccagctcaatcagtactcatctaccctccccagtatttactttccatttatttctaacctagaggtcctcttctaacagaaaaccaagtactgtatgttctcttataagtgggagccaaatgaggagaacacatggacataaagaggggaacagcagacactggggtccactgaagggtgggagaaggggagaggagcagaaaaatcaactattgagtgctaggctttgtatcttgagtgacaaaataatctgtacaacgaactcctgtgacatgagtttaccctacataacaaacctgcaca

SEQ ID NO: 27051 - DNA, 426 bp, Homo sapiens
ggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttg

SEQ ID NO: 27052 - DNA, 130 bp, Homo sapiens
  misc_feature 8, 13: n = A,T,C or G
ctcggccntttantggcccgggatattaaagttgctgcagttaaaagcccgtccccgcccccttgcctctcggcgccccctcgatgctcttagctgagtgtccccgcggggccccgaagcgtttactttg

SEQ ID NO: 27053 - DNA, 476 bp, Homo sapiens
  misc_feature 464: n = A,T,C or G
ctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaactttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggnagaatgtgctct

SEQ ID NO: 27054 - DNA, 474 bp, Homo sapiens
aaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaaccctcctgcaaaaaaggcatcttgtccctacatcttctcttctgactttggctacatctcatagtaagttcagagtagttcatgataaattgaaaatataatgggtcatttgcagaaaatgattgatgttgtaactgtccacccaagtaagaagtgtatctg

SEQ ID NO: 27055 - DNA, 500 bp, Homo sapiens
  misc_feature 7, 8: n = A,T,C or G
ctcggcnntttatggcccgggaggaaatgttattttgttttcaaaatatggcagagatggggggtggtgggcggggtgggatccctaacgtaatattctttatgaaagcattagctgcttttgttacatttttaatatgcaaccacttcttcacctgaggaaaactagaatgaaatgcggtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgacctgttctaccttgaggctttgtttggtttatttattaaaagtgtacagtatttaaaaaatcaaacatagctttagttaaaacactaagctgaattagtcatgtccattcagacataacctgaactactgaaaagatcaatttccagaaggtt

SEQ ID NO: 27056 - DNA, 468 bp, Homo sapiens
gcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 27057 - DNA, 136 bp, Homo sapiens
catgctgctgtggagctcttacgtttccagtagtctatcttgagcaaagagtatgaataggtgctgaggactaaggaaaacattcactctttgggtcctgagatgcattagacccagatctctagggtggtagctt

SEQ ID NO: 27058 - DNA, 465 bp, Homo sapiens
ggctgatttctcctagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggatttttt

SEQ ID NO: 27059 - DNA, 163 bp, Homo sapiens
  misc_feature 6, 12: n = A,T,C or G
agtatnaaaaantattttggacagttgcttaacatggtcataagaggatttgtactatagaatatcttctagtactaatttttctgtagagcaaattatatttctctcactggatagtttttagatgtgtttcttcatataaaattaaaaactgagatggaat

SEQ ID NO: 27060 - DNA, 427 bp, Homo sapiens
  misc_feature 2, 3, 365: n = A,T,C or G
cnngcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtgggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgagganatggggaatttgggcctctttggactaatcaccaaaaagcaaccaacttagccagttttatt

SEQ ID NO: 27061 - DNA, 421 bp, Homo sapiens
  misc_feature 7, 31: n = A,T,C or G
tcggccntttattggccgggagaaaaaaaantacttataaaattacctacttctgaagagcattccgaaagatgggactggttgactcttcacatgatggaggtatgaggcctccgagatagctgagggaagttctttgcctgctgtcagaggagcagctatctgattggaaacctgccgacttagtgcggcgataggaagctaaaagtgtcaagcgttgacagcttggaagcgtttatttatacatctctgtaaaaggatattttagaattgagttgtgtgaagatgtcaaaaaaagattttagaagtgcaatatttatagtgttattttgtttcaccttcaagcctttgccctgaggtgttacaatcttgtcttgcgttttctaaatcaatgcttaataaaatatttttaaaggattac

SEQ ID NO: 27062 - DNA, 363 bp, Homo sapiens
caggagtcttctctgaaatttctgagaggccacacaatcttaggttgaataaagaaggaataagaataggaagtacggggccgggtgtggtggctcatgcctgtagtccaagcactttgggaggtcgaggcgggtggagcacctgaagtcaggagttgaagaccagcccggccaacatggtgaagccccgtctctactaaaaatacaaaattagccaggtgtggtgatgggctcctgtaatcccagctatttgggaggctgaggcaggagaattgcttgaacctgggaggtgggaggttgcaagtgggcccgagatcgcgccactgcactccagcctgggcaacagagtgagactccgtctcc

SEQ ID NO: 27063 - DNA, 388 bp, Homo sapiens
  misc_feature 312, 359: n = A,T,C or G
gcaatggaatttgaacagccctttggaaaagcatttggccacaattttaaggaatcataaaatttctacatactttgacccagccatcccactcctgggaatttgtcctgaggcaattattaaaaagacaacgaaagccatgtgtaggaaaaagttaactgcaatagtatttataatagtaaaaattggaagtcacctaaaggtctcataacaggaagtgatttggtaaattatggttctgtgtattagggttctccagagaaacagaaccaatagggtacgtgtgtgtgtgtgtgtgtgtgtgtgtgtgtntgtgtgtgaagagactttttaaaattaggaattggcttatgtgattntggaggctgagaaatccggacccagcaga

SEQ ID NO: 27064 - DNA, 450 bp, Homo sapiens
gggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaaggctggccaccaaacagagcagtggctaaattgcagtagcagcatatctttttttctttgcacaaataaacagtgaat

SEQ ID NO: 27065 - DNA, 187 bp, Homo sapiens
  misc_feature 184, 186: n = A,T,C or G
acatatttatattttaaagcaaattttatatatgttaagaagtctgttgtaggctgtgaatgtccctatctgttttggaaatggccttttagaagaggtggtacatgaaacaagcatttgaagtgtgaaatttgacatgcagatataagagaagactattccaaaaattttgtaaacctaaatntng

SEQ ID NO: 27066 - DNA, 467 bp, Homo sapiens
gcctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtgggagatgccccagctgctggtgaagatgcatgaaataggtccaaccagctgtacatttgg

SEQ ID NO: 27067 - DNA, 366 bp, Homo sapiens
  misc_feature 19, 365: n = A,T,C or G
caaagcagtggacaagaangctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagaccggttaatgataacaatgcatcgtaaagccttcagaaggaaaggagaatgttttggggaccactttggttttcttttttgcgtgtggcagttttaagttattagttttttaaaatcagtactttttaatggaaacaacttgaccaaaaatttgtcacagaattttgagacccattaaaaaagttaanc

SEQ ID NO: 27068 - DNA, 473 bp, Homo sapiens
ggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaaga

SEQ ID NO: 27069 - DNA, 382 bp, Homo sapiens
ggaaatacaaatatggaaatacagcttgttcaatcatttagagcccatacttctaacggtgtacatatgtagacgtgactttgtaaagaagacccacatgtgtgtctacactcaagcatcttcctcttaatactctactgaggataaaggacgcaaagtaatttttgaaatatcatgctggctacttttagagtatattagtgtgagtagtgacttaagaggtcaggtttaagagaagtagcaacatacttctattatttacatggtgatttttttttataagtccttccttgaaggcagacttagatatttcaagacctccttagaaaaatttttcagcaccttctgtgctccaaattgagtcagtttgcatcatgtttca

SEQ ID NO: 27070 - DNA, 476 bp, Homo sapiens
ggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtaagttcagttcttaaccaatgacttggggatgatgcaaacaattactgtcgttgggatttagagtgtattagtcacgcatgtatggggaaagtagtctcgggtatgctgttgtgaaattgaaactgtaaaagtagatggttgaaagtactggtatgttgctctgtatggtaagaactaattctgttacgtcatgtacataattactaatcacttttcttcccctttaca

SEQ ID NO: 27071 - DNA, 217 bp, Homo sapiens
  misc_feature 25: n = A,T,C or G
ggagtgcggtaacaccgttcacagnagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggac

SEQ ID NO: 27072 - DNA, 125 bp, Homo sapiens
gtatgtttagaattatgctagggttttatgtttaccaagcctcaaaatacccatcatagtatttataaaggctttctcttacatgagtaggagtctgaatgcttctgctttatcatacatcatgt

SEQ ID NO: 27073 - DNA, 458 bp, Homo sapiens
aggagagtcccctgaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagg

SEQ ID NO: 27074 - DNA, 371 bp, Homo sapiens
ggttctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcaagtgaaggaactgaaatgaaccagacacactgattggaactgtattatatttaaaatactaaaaat

SEQ ID NO: 27075 - DNA, 472 bp, Homo sapiens
  misc_feature 43: n = A,T,C or G
ctgtggagtatgtaccgacggccgatgctgcaccccccacagnaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaaggtgtggctttagga

SEQ ID NO: 27076 - DNA, 157 bp, Homo sapiens
ctcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcc

SEQ ID NO: 27077 - DNA, 412 bp, Homo sapiens
aaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatcac

SEQ ID NO: 27078 - DNA, 100 bp, Homo sapiens
  misc_feature 2, 3, 6, 8, 18, 20, 26, 28, 29, 30, 34, 36, 42, 43, 45, 48,49, 59, 63, 67, 71, 83, 87, 92, 93, 95: n = A,T,C or G
gnngangnatcaatcggnangtgcgnannnggancnaccgcnnanagnntgcgaatgantganatgntganatgcaagggaancatngaatnntngacac

SEQ ID NO: 27079 - DNA, 282 bp, Homo sapiens
  misc_feature 281, 282: n = A,T,C or G
gggtgccgggttgggcttctccagatgccggggctgggtccttcccaaggttgagacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcaggaaaacgaagacaaaacagtcgaatagagcaaagtgtttggccnn

SEQ ID NO: 27080 - DNA, 393 bp, Homo sapiens
  misc_feature 345: n = A,T,C or G
agacaggtctgtgccacctcctctctcctctgtgctcagtgaggaggcagtaaatgaagttacaggctagcacaatacctaactcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagnaagttgatgtgcttgtttgacatttgtctcattaaaacttttctacgc

SEQ ID NO: 27081 - DNA, 337 bp, Homo sapiens
ggagtgagagggcagaggaaatactcaatctgtgccctcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatgggagatgacagttcagaagaggagggaggaag

SEQ ID NO: 27082 - DNA, 274 bp, Homo sapiens
attgcagcttcacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatga

SEQ ID NO: 27083 - DNA, 116 bp, Homo sapiens
caggaaccagtgcaagaggctccaaaaggaagaaaaagaaaacccagaacaacagaaccaaaacaaccagtggaacccaaaaaacctgttgagtcaaaaaaatctggcaagtctgc

SEQ ID NO: 27084 - DNA, 489 bp, Homo sapiens
  misc_feature 8, 10, 34, 35, 52, 75, 94, 225, 383: n = A,T,C or G
tagctganantaatgatacctgtcaatttgaganngcagaagtttcacacantcaaagtaaaagatgttgcatantccttactacctaaatgcnaaatgagtcgcttaaccccttgacaaggtcaaagaaagctttaaatctgtaaatagtatacactttttacttttacacacttttcctgttcatagcaatattaaatcagaaaaaaaaaatgcggggaggtntttaacagctgagcaaaaacattgagtcactctcaaaggacacgaggcccttggcggggaatatttaaagcaacttcaagtttaaaatgcagctgttgattctaccaaacaacagtccaagattaccatttcccatgagccaactgggaaacatggtntatcattgaagtaatcttgtcaaggcatctggagagtccaggagagaagactcacctctgtcgcttgggttaaacaagagacaggttttgtagatttttgattggg

SEQ ID NO: 27085 - DNA, 481 bp, Homo sapiens
  misc_feature 28, 134, 436, 479: n = A,T,C or G
aggcaagactcttaataaataaatagtnaagccacttgaaatcagggatccaatactcttctcccatagcaaaatcaagagctgtttaagctctaaggctctatctagcccaaaaacaaatgctataatgtttnctttggtggtgtttctaaattcaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtngggaggaaaacctctatagcagctccctgggaggaaagggggngg

SEQ ID NO: 27086 - DNA, 475 bp, Homo sapiens
agcttttgaaaatgtgaaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtca

SEQ ID NO: 27087 - DNA, 328 bp, Homo sapiens
  misc_feature 12, 13, 117, 121, 124, 236, 291: n = A,T,C or G
cccggggaggcnntgaggccagccccagccgccggggccttcttgctgagggggcaggccggagcttgaggaacccgcagataagttttttttctctttgaaagatagagattaatnccanctnccttaaaaaaatctagtcaataggttactaagatattgcttagcgttaagtttttaacgtaattttaatagcttaagattttaagagaaaatatgaagacttagaagagtancatgaggaaggaaaagataaaaggtttctaaaacatgacggaggttgagatgaancttcttcatggagtaaaaaatgtatttaaaagaaaat

SEQ ID NO: 27088 - DNA, 100 bp, Homo sapiens
  misc_feature 6, 7, 36, 42, 44, 45, 50, 51, 54, 56, 68, 69, 70, 80, 97, 98: n = A,T,C or G
cctggnnaattcaatccttatgtccgggccggtatncttatncnngtaannatncngcactcttgctnnntcctaggctnactgcttctggatgtgnnga

SEQ ID NO: 27089 - DNA, 392 bp, Homo sapiens
  misc_feature 5, 34, 41, 97, 124, 167: n = A,T,C or G
tctantggcccgggggtttgtcctttctttgccntgccccntgtgtcgtaaaaaatgggggtccctttacctgcatttatcaagggaaaggcaaganctgggacgtctagtcccacaggaagancctgcacccactgtcgccttcacaccaggtgaactcggaaganaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttcct

SEQ ID NO: 27090 - DNA, 301 bp, Homo sapiens
  misc_feature 15, 21, 156: n = A,T,C or G
gttcttccctttcantggctnaactttcacttgacttttttcccccctctaactcagcgtggtattggagaagagctttagcccaagcccagatggacaagtcacctgataggcccacattcttgctaggaatatgtaagctatatattggcagantttgtttaaggtccaaagttcaaggtttcagctatggtcaccgcggatcatatcagacttgaagtgagagctgctgtcctgatttgaaacagtctgcataacaaactgttgggcacccactgaaatgtatcagggaactcgctac

SEQ ID NO: 27091 - DNA, 208 bp, Homo sapiens
  misc_feature 6: n = A,T,C or G
caggangaaattccacaaaacaatgtcaaccttaaatgtaaacaggctaaagctccaattaaaagacacagactggccagttggattaagaagtcaagaccccatcagtgtgctgtattcaggagaccccatctcacatgccaaagacacacataggttcaaaataaagggatggaggaatatttacccaagtaaatggaaacaaacg

SEQ ID NO: 27092 - DNA, 395 bp, Homo sapiens
  misc_feature 16: n = A,T,C or G
tatggccgggatgaantgtaagctgcagaaatagataaaacacaggtttccactaataaaagacatctgaacgtcctgaatatagagacagaagttttttgttgttgttgttgttgttttaacatgtttaaccaacagaagttatttacagaaattcatatatccaggcaacacaaaactcctttattcaaaatcactgctatctttgggactaaacacaggctactttctgtttactcctaacaaaataaagcaagcaaatttgagtcaaatattggtgcactttaatactatcacatctttgaaaactcaatttgagttttaccaattaatgtgtctcatgaagagaagacaccagttttaaaatgagccacaaacagtaaagccctatcagc

SEQ ID NO: 27093 - DNA, 394 bp, Homo sapiens
  misc_feature 9, 337, 362, 369, 388: n = A,T,C or G
cattcaganagcatcttatacgagtaatatgccctgctattttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatgnacagttatctaagttaatttaaagntgtgtgngcctttttatttttgtttntaatgc

SEQ ID NO: 27094 - DNA, 482 bp, Homo sapiens
ggtctttgggccggcgcgaaccatggccggcatggtggacttccaggatgaggagcaggtcaagtcctttttggagaacatggaggtggagtgcaactaccactgctaccacgagaaggacccggacggttgctatcggctggtggactatttggaagggatccggaagaattttgatgaggctgccaaggtgttgaagtttaactgtgaagagaaccagcacagtgatagctgctacaaactgggggcctactatgtgactggaaaaggtggtctgacccaggacctgaaagctgccgccaggtgctttttgatggcgtgtgagaagcctggaaagaagtcaatagcagcatgtcacaacgttggcctcctggcacatgatggacaggttaatgaaggatggccagcctgacttgggaaaggccagggactactacacaagggcctgtgatggtggctatactttccagttgcttcaacct

SEQ ID NO: 27095 - DNA, 290 bp, Homo sapiens
cactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtgggccg

SEQ ID NO: 27096 - DNA, 241 bp, Homo sapiens
  misc_feature 17: n = A,T,C or G
tcccgggtcctcggccnttattggccgggaatgttttgatgtttatgtaattttacttgccttttaaaagtttaatgtttaatattgttactgtcatacttttaaacataatatataattaaaaaatatatttgtctaaagcattataaaaagaatttttgtaggttgcctatggagaaaatttttgcaatctatccatctgaaaaaatgctaatatccagagtctacaaggaatttaaat

SEQ ID NO: 27097 - DNA, 144 bp, Homo sapiens
  misc_feature 13, 15, 29, 31, 33, 48, 50, 51, 64, 72, 76, 80, 97, 99: n = A,T,C or G
ctcggccatttantngcccgggggggaantnanggttcgattccggananngagcctgagaaancggctacnacantccnaaggaaggcagcaggcncncaaaattaccccacttccccgaacccggggaggtagtgaccgaat

SEQ ID NO: 27098 - DNA, 465 bp, Homo sapiens
  misc_feature 38, 60, 203, 248, 288, 451: n = A,T,C or G
actgctcaatgaaataaaagaagataccaccaaatggnagagcattccatgctcctgggnaggaagaattaatatcgtgaaaatggccatactgcccaaggtaatttatagattcaatgccatccccatcaagctaccaatgactttcttcacagaattggaaaaaactactttaaagttcatatggcaccaaaaaaaagccngcatcaccaagtcaattgtgagccaaaagaacaaagctggaggcntcacgctacctaacttcaaactatacgacaaggctacagnaaccaaagcagcatgatactggtaccaaaacagagatatagatcagtggaacagaacagagccctcagaaataacgccacatatctacaactatctgatctttgacaaacctgacaaaaacaagcaatggggaaaggattccctgtttaataaatggtgctgngaaaactggctagc

SEQ ID NO: 27099 - DNA, 480 bp, Homo sapiens
  misc_feature 1, 10: n = A,T,C or G
ntagctgaantcgctacatatttgccgcatgtctcacttagtttagcaatttgtagtgagttaaaataagtaagcatgttaccatccaagctgtgtcaaacacaatttaatggttgtgtaagaagttaagcgcactcagcccctccagggctgcatctttgtggctatcccgatccccattattgaggggggtgtagaggctgaagacagggtttggggactttactttagtgtcagttgtgtgtttctcacaatgaggtagagtgagccactccttggctatctcaatccatttccctggatcctgaatcaataggaacgtgttacaatgtttgctcattcttgcctgcttttaagtattttgaataagctaggcaattaaaaaaaattttttaagagtgcttcataagatgaatggaagggttaagttgctgactaatattcttggatccagaatattagtccttcactttatggtct

SEQ ID NO: 27100 - DNA, 479 bp, Homo sapiens
  misc_feature 20: n = A,T,C or G
ggaacctaacaaagaagccncaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaag

SEQ ID NO: 27101 - DNA, 467 bp, Homo sapiens
  misc_feature 1, 4: n = A,T,C or G
nagnaggagtttgttattacccaccttctgaagcctacttctgtaaattcatcaaactcattctccatccagttttgttcccttgctggtgaggagttgtgatcctttggaggagaagaggcattctttgtaataaatagctcttattatgttgagaaacatttcatcaaaacctagtttatggaatgttcagcctttttgcactgtttttttcctcatctttgtggatttatctacttttggtctttgaagttggtgaccttcaataggatttctgtgtggacatctttttttttatgttgatgctattcctttccgtttgttagttttccttctaacagtctgggccctctgctgcaggtctgctggagtttgctggagatccactccagaccctgtttgcctgggtatcaccagtggagtctgcagaatagcaaagattactgcctgttccttcctctggaagc

SEQ ID NO: 27102 - DNA, 128 bp, Homo sapiens
  misc_feature 2, 16, 29, 30, 40, 41, 43, 46, 48, 50, 65, 66, 67, 69, 70,71, 73, 78, 83, 84, 88, 95, 100, 103, 117, 118: n = A,T,C or G
antacgcgggccatantaagggcccgggnngggggctggnngnacnangnggtggcccaaggggnnngnnncntggcnaaagnngganacgttcnagaanaangtggcaagcttggnnggtggccttg

SEQ ID NO: 27103 - DNA, 284 bp, Homo sapiens
  misc_feature 9, 26, 32, 37, 38, 39, 44, 52, 53, 54, 60, 67, 68, 71, 72,76, 80, 93, 96, 104, 141, 200, 203: n = A,T,C or G
cctggaagnccagacgtccgggaagngccgantgacnnngaccnagagacgnnnaggganattaganngannaaantccntaccttttagaanganaaaaaganaaaatttaaacccctgaaaagtaggaagccagaaganaaaagaccaagcctaggaaaccaaaaaagcctaagggcaaaatgtaccaaaccttaganganaattggaagatagaaaccaagatagaaaatgaaaatattgtcaagagtttcagatagaaaatgaaaaaccaagctaagacc

SEQ ID NO: 27104 - DNA, 241 bp, Homo sapiens
  misc_feature 5, 6, 27, 30, 31, 35, 41, 64, 93: n = A,T,C or G
cggcnntttattggcgcgggatatccnaannaacnaaagcnttaatatttcgcccactaagccnatcactttattgactcctagcccgcagancctcctcattctaacctgaatcggaggacaacccagtaagctacccttttaccatcattggacaagtagcatccgtactatacttcacaacaatcctaatcctaataccaactatctccctaattgaaaacaaaatactcaaatgggc

SEQ ID NO: 27105 - DNA, 451 bp, Homo sapiens
  misc_feature 6, 14, 29, 36: n = A,T,C or G
aaaaanctgcctcnacctacattggaaanctgaacnaaccctgctcctgaataacctactgggtaccctaacgaaatgaaggcagaaataaagatgttctttgaaacccaacgagaacaaagacacaacataccagaatctctgggacacattcaaagcagtgtgtagagggaaatttatagcactaaatgcccacaagagaaagcaggaaagatctaaacttgacaccctaacatcacaattaaaagaactagagaagcaagagcaaacatattcaaaagctagcagaaggcaagaaataactaagagcagaactgaaggagatggagacacaaaaaacccttcaaaaaatcaatgaatccaggagctggtttgttggaaaagatcaacaaaattgatagaccactagcaagactcataaagaagaaaagaggaggaagaatcaaataga

SEQ ID NO: 27106 - DNA, 493 bp, Homo sapiens
  misc_feature 2, 5, 23, 32, 74, 159: n = A,T,C or G
gntgnctcgaagaattcacagcntatattggnggattcttgtccatagtgcatctgctttaagaattaacgaangcagtgtcaagacagtaaggattcaaaccatttgccaaaaatgagtctaagtgcatttactctcttcctggcattgattggtggnaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaaca

SEQ ID NO: 27107 - DNA, 419 bp, Homo sapiens
  misc_feature 18, 19, 54, 63, 373: n = A,T,C or G
tggcccggggggaaagannaggggttattcaaggagtgatgaccgactgagganccttaggcnccccctccttttagagggtatgaagaggaggaggagcccaaaaaaggaggctgacaaggggagcccaatgagacagaaagtaaactaagaaagttatagtatccctgtaagcccaaatacctgacagtgtttcaggaaggagggatgctttaattggcccagttctgttgggaggtcacctgaggtgaacattaagaaatggtttggcaagatggagacttattgggtgaagttcacaagaactattttgtttggagtgctgaggacaaaagcctgattgaggtgggtcaggggaaaatggggaaagagnaagaaggaaacaaagtatgggcaattctttggtggtgatttgcttt

SEQ ID NO: 27108 - DNA, 477 bp, Homo sapiens
  misc_feature 452: n = A,T,C or G
ggcgctctgcggctgacggcgcttttgtctccggtgagttttgtggcgggaagcttctgcgctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctanacatgtccagatggggagtcccatt

SEQ ID NO: 27109 - DNA, 158 bp, Homo sapiens
  misc_feature 14, 21, 28, 47: n = A,T,C or G
tattggcccggganatttgantttttcntgccagtttttctagagcnataatcagtggtgcttttgtaccctaggttttatgtgattttaatgaaacatggatagttgtggccacctgctgactatttgtggtttaaaataaaaggtttacttgtctg

SEQ ID NO: 27110 - DNA, 494 bp, Homo sapiens
  misc_feature 6, 19: n = A,T,C or G
atggcncggggggaagaangcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagc

SEQ ID NO: 27111 - DNA, 470 bp, Homo sapiens
  misc_feature 23: n = A,T,C or G
ggcgcaatagatatagtaccgcnagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttatagggtaggaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 27112 - DNA, 431 bp, Homo sapiens
gtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaagtctggtacaactgtccttagactgatgagcaaaggaggagtcaactaatgaagaaatgaataataaaattttgacactgaaaaacattttattaataaaggaatattgacac

SEQ ID NO: 27113 - DNA, 341 bp, Homo sapiens
aagcttatgatttataagttacaatataataaccttacagaagctttagtagttaaaaagcatttgactcctaaaaagtaagtatgaaaatgaaacatggtttaggataagcagtcagtttcttttgtaagctacttcaatgtagttttataaaaaatcaaaaaagatatatactgtaataaatttttccttgtggggaagtatagagatataatctcagtatttctttttgactagaaaacttcagccactgtgtattttcatatttaaaataagctactttaaaagcatatatcttaaattgtcttatttgtattgctttaagcctcagcaggtagagt

SEQ ID NO: 27114 - DNA, 213 bp, Homo sapiens
  misc_feature 4, 15, 41, 123: n = A,T,C or G
aaantaatgtttttnaaagttttcttagtaaccctaaagangttctgtggtttgacctcccaggataaaaacaccaaggcacctttgtctgtatttactttccacttactaattgttttatantatttctgctgttaaaaatgtttaagattgcttcccactcataaatatataatacattgaacttaaaatatatttgttaaccagttctcc

SEQ ID NO: 27115 - DNA, 100 bp, Homo sapiens
  misc_feature 2, 15, 29, 37, 38, 44, 65, 74, 75, 82, 83, 84, 85, 88: n = A,T,C or G
tntggcccggggccnaaggttagactgantaactttnngtgtantttttaatttgaatgttgggnctttttaanngacccannnntanaggggaaccttt

SEQ ID NO: 27116 - DNA, 499 bp, Homo sapiens
  misc_feature 3, 30, 34, 43, 67: n = A,T,C or G
tantggcccggggggcctcagggcctgccnagantcagccggntgctggatgggccctgcagaaaancaaccacctcacccacacacacctttccttcaaaagacccaaaagtgactggtgtctcgtgtgacagattgcttcatttatgtttctacatagtaaggtgactgccaaataatttttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtttgggagaacagtcattgaattggggaggttttgttaataaata

SEQ ID NO: 27117 - DNA, 292 bp, Homo sapiens
  misc_feature 8, 9, 35, 37, 41, 42, 59, 75, 80, 85: n = A,T,C or G
tccggccnnttttattgggcccgggccttttgaancntaannaaccactttgtgaaaanctctcagtcccagaanatgcnagagntttgtgaagatacccaccccactttctgatacaaagtcagatacctgcaacaggaggaagaaagtgcaggcccatgccacttcctctcaggagcctagtggatgctcagatcagagacctgcagaggacctcaacatccgagtggaaagactaacaaaaaaacttgaagaaaggagagaagagaaaagaaaaggaggaagaacaggg

SEQ ID NO: 27118 - DNA, 283 bp, Homo sapiens
  misc_feature 7, 45: n = A,T,C or G
attggcncgggagttggagatcagcccttggcaacatagtgaganccctgtctctacaaaaaaatttaaaaaattaaaaaaattaatatgtcctatttctttagcaaaatcattggctccttgaggggagagagcttgtcttatatgcccctttgtaattccattgcctagcacagcagatgttgtcactaataggtttgattctgtgatttggatccaatgtcattgtgacaggatactttttcccccataataggttatttttatatgactttatgcccac

SEQ ID NO: 27119 - DNA, 402 bp, Homo sapiens
  misc_feature 15, 23, 27: n = A,T,C or G
tggcccgggggaaantagtaganagantctaagtttatgattagccctacagaatgaaggttctgtatctttggaaaaatgtcaagaacatgaaagacctggagagactgagaatatgggaggagaatgaatgtcctgacgatactggggcagttgacaaagtttgaatgacgtctgtagattgatagtagtgttgtacaaatgttgattttctgactcaaaggcttatatggtgattctgtagaagaatgtccttgtcttaagaagtactggagtatttagggttgataggaatcatgtctgctgcttgttcttggatacttcagaaaagactaattatgggtatacgtatatgcttaggggaagtgtatccatttttttaaaaaaaaagaaaaatggagc

SEQ ID NO: 27120 - DNA, 341 bp, Homo sapiens
  misc_feature 20, 59: n = A,T,C or G
gtagtatataaagttcaatnaggaaaatacatgctacatattatatctatagatttgcntatacatatatttttctatgttgaaatgttattcactctatattacaattttatttatagaacttaatgcacaggtatttacataaagaagataagtatattaaaatatttgaatgcagtatataaactatgcatttttgcatatgctataattataacattaaaatgaatatatttacaatatatttatatatatttaggtttttctcatgtacattttcacaagcaaaatgtatacatttccgcttttgcataaagaacccaatcttaggaattcgtagc

SEQ ID NO: 27121 - DNA, 477 bp, Homo sapiens
  misc_feature 2: n = A,T,C or G
cnttatggccggggaacctcaaaacaaaaactgggagatgactggttctgggcctttaaggaaatctctgtctggccattaactgaccactaagctaactgaggagagacttagtggccacacatggtagataatacagattttgcataattaattcagaaaagttaataataaactacaacaaactctgggggaatggaggtgtatcttggtttctggagttgccacattatactatttaaaatgttcatttttcaacaaaaaattgtgagatgtgagaaagcacaagaaagtatgacctacacatggggaagaaagcaatcgatagagactgtcattgaggaagacaagatgctggatgtaccagacaaatactttaaatttatggtcttaaatatcttccaagaacaaaggaaaacctttctaaataatttaaagtataagagtggatggttttaccacatagagaatatcagt

SEQ ID NO: 27122 - DNA, 462 bp, Homo sapiens
gggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagat

SEQ ID NO: 27123 - DNA, 299 bp, Homo sapiens
  misc_feature 2, 25: n = A,T,C or G
cnttatggccggggttgctcaggantgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttccttta

SEQ ID NO: 27124 - DNA, 472 bp, Homo sapiens
  misc_feature 196: n = A,T,C or G
ggaagtgggcagtggtggtttgaagaaaagtgtgtaattgaataatctgttctagtagcatggatgaacccagtctgcttgaaacaagtaaaaggagtttgatgagaaatgcagttagaaagttgggaagaggccaatttggggaacagaataagccaaatctgcatatttaacaattcaaagtacaggtgttacnttcaatgccacctaaaggctgaaagagtaggatagcacaattaaatggagtggggaatatggtttcctttatattcctagacaaaggaaagtgttaaggaaataccatgcagccgttggaatgattatgtatggataggtttattgacacaaaaggacattaattattttatattttggtgaaacagagaatgtgacatcatgtatggaaaattagattccatttttaaaacatctgtaaatgtacacaattcctatgcaatttcaatatgaattt

SEQ ID NO: 27125 - DNA, 488 bp, Homo sapiens
  misc_feature 2, 11, 15, 24, 50: n = A,T,C or G
gncattaatcntgangaattagcnccaagggattaggaaaacaattcttnttctggaatttgttaatcaactaaattcctgaacctgtaaaattattatttttaaattatgtatgcataatttatgtatgcatggttttacatattttatatataattttaaaatgtatacatttacacatttctgggaagactgtcaagaactccatcagtctttcaaagactgtgcaaatccccatgaagaaatgctacatttgagttttcacggttcagtcattcagtgaaggaacccagtgttgaacatgcgaacgtctttgctacaaataataaatatgctgcaggtacattgacatttgggtttatttcctaatggatcattgcacggtattacctttgcaataaattaggctatactttaggtatatggtgaaaactgattcttctatgaaactataaaatgtcatttgcattttgttccaacctatacca

SEQ ID NO: 27126 - DNA, 309 bp, Homo sapiens
  misc_feature 14, 16: n = A,T,C or G
cagggaacttcagnancagaaagaaaaagaataactgctcacccctcaacaaatgtggaaggttgtgatgtgacaagaaatcatttcaccagttcagtaaatgatgttgtctcccaataaatgtcatgaatgatcccaagtccaaaattttttaactcattgtttcactcccaagggagaacaaagctacatgcagatctcatgtttccatgtttcaaaattcattttttctttggtgcttacagaacttcaaattggatttgttataaccaccaagatcagttttgtttttgtggattggtgtgtgtg

SEQ ID NO: 27127 - DNA, 445 bp, Homo sapiens
  misc_feature 3, 12, 87: n = A,T,C or G
cgngaaggagancctgagctgtcacaatatctgcacaatcccttgatctgatgggttggaatggctcttaaggttgtcccagtttanacagaggggatcagggtctttttacacccctcacattgatgagtccttgaatgcaagatgcagctctggatgggaaggggaataatcttgggccaggtggctcttttgggctgagggtgctgcccagatggtgactcatctggcagctgacattcaccaaaacgatcaagagctggaagagtgagtgtccagtcccaaacagggcacctagtgatgcaccagtgtaccatcacatgtgcatatataatattatttgcattcattatgaatgtctcgatttgttttgtaatagatctcccaggctcagattgagaaaaacataaaacaatttttattacaataccaaaattaactggct

SEQ ID NO: 27128 - DNA, 461 bp, Homo sapiens
  misc_feature 7, 15, 68, 363, 426: n = A,T,C or G
tcggccnttatggcncggggggctccaatgtcccctgggccctttatgcaaggggaaattgcaaccantccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggngacagttaccgttctatgtaggctgtgacttgcgctgcttttttagagcacttggcaaatcanaaatgcttctagctgtatttgtatgcacttatttt

SEQ ID NO: 27129 - DNA, 289 bp, Homo sapiens
catgacattggttaacatttaaatgttcctcctgtacttgtgttgtctgtgaccgcttatagagttttattgttattggtgtttacctgaatacctatgcgtacacacacacatatttccttaatacttctgaactcgttatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgt

SEQ ID NO: 27130 - DNA, 179 bp, Homo sapiens
  misc_feature 3, 27: n = A,T,C or G
aancccatacatgagctctccctgccncattgagatgatccttacggaaaaggaacagattgttcctaaaccggaagaggaggttgcccagaagaaaaagatatcccagaagaaactgaagaaacaaaaacttatggcacgggagtaaattcagcattaaaataaatgtaattaaaagg

SEQ ID NO: 27131 - DNA, 434 bp, Homo sapiens
acaacaaaaggtaaataggacaatcatcttcgaaaatggattaggccagattggtagtacccaaaaggagaattaatgaccattgtcataaactctgaaaagctgttggcgctactgataatctagataattaagcaaaaatttgaaaattatttctaagattgtctaatgaagttcactaagtgtttttgttaggttatcactattgggcaccatggggaaagcaaaataattgtatagctaggtcattgccccaaaggaaaacaggaaagatgtcacatgaagtgtttaagaatcaaaatgtaattagctgagtgtggtggtgcctgccttgtagtccccgctgaggtgggaggatctcatgagcccaggactttgaggctgcagtgagccatgattgcaccactggcagcctgggcaacagagtgagactg

SEQ ID NO: 27132 - DNA, 472 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatat

SEQ ID NO: 27133 - DNA, 453 bp, Homo sapiens
ggagaacccttccggtgggctaggtactgagcgcgcgaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgctgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttttctccatctcttttctttgtacaatcccatttcctattaccattctctgcaataaactcaaatcacatgtctg

SEQ ID NO: 27134 - DNA, 179 bp, Homo sapiens
atctactttttattcttttgataaatgtttatgaaatataaaatactgaaaattagaaagtagaagtcattattttattataaaacatgtggattagatattttcatttatgtgattaaactttctaaacaaagattatatgaattatcttaaagatttaaaaagtaattaagttaaat

SEQ ID NO: 27135 - DNA, 465 bp, Homo sapiens
aagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttga

SEQ ID NO: 27136 - DNA, 226 bp, Homo sapiens
cacgtacaaacattcttagatatgagaatacagaacatgaagcaaggatggggaaaaagtggagttttagctttcgacataataatgatgactttctcctgggtaataggagcagtgtacagcattcagtgttcatcagtttctacaaaagaccttatgcatattctgtatgttcattcaatatttcttgataacaggccctgttatagacacagggcagattaca

SEQ ID NO: 27137 - DNA, 347 bp, Homo sapiens
  misc_feature 5: n = A,T,C or G
caganaagctggatttttctcctcctcactcccaaacactgcccaggatttcagctgtgattatataaataacattttaagggcaattttgtgcatttttcaaactgtagaaaactagtcatggtgaagaagtttctctgtgctaatgtgaaaatgaaatcaagatcattttgtgttgtcattgttttgtaaagatgaaaggtggaccgggcatagtggctcatgcctgtagtcccggcgctttgggaggctttggtaggaggattgcttgagcccaagaggtcaaggctacagtaagccatgaccacaccactgcagtccagcctgagcaacaggacaagatcctg

SEQ ID NO: 27138 - DNA, 299 bp, Homo sapiens
  misc_feature 3, 19: n = A,T,C or G
ctnccccgggaattcggcnttatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattga

SEQ ID NO: 27139 - DNA, 313 bp, Homo sapiens
  misc_feature 8, 23: n = A,T,C or G
ctcaaagnaataagaaaacaagnaaaaaacagtagcaataaaaatattgttacttggaaaacagatgacaagtgacaactaagcagcctaagaaagctgaaccttaagtcagtggtaggcaaaaaacaaagaagcagcttgacttacattgtaaaattctccagaagctcaggagctgcaagtgaagatgaaggtagaactgaagacatgacaactggtcagaagcttctgaaagaggaattagattcccttccctatgtcagcaaaagactgaaaatttaattctctgaaaagcgtacaaaatgtctgtggt

SEQ ID NO: 27140 - DNA, 464 bp, Homo sapiens
  misc_feature 19: n = A,T,C or G
gcgattcatgttctctganggaccagaatgttattagaaaccttgcctgccaaatgctgggcaaatgtaaccaatttattaatgcggggaatccaatatgtgaaattggaccaaaaggagagaggccagccaccctctctccacacttcctgatctctaacaggggtggaaggagggtgatgtaaaagagttatgtcttctgcaagaggacgttgctgtcctaatcacatgtgatagtgacgacagatattcctgactggagcttcaaagggctgggagataattgtatccactatccccggctggctgtgaggctcagcctgcagcttgcaggttgtaaagcacactgggtaggaagatcgggagcttggtctcctctgtcccagttctgcagctctgcaatagagaccaggtgaaaatggacgagtaagaatatctctcagtgcctgcaatgctgacatcat

SEQ ID NO: 27141 - DNA, 263 bp, Homo sapiens
  misc_feature 262: n = A,T,C or G
tataagaatagctactcctagactggccacagtggctcacgcctgtagtcccagcactttgggaggccgggatgggcggatcacaaggtcaggagttctactaaaaatacaaagaagttggccgggtgtggtggtgtgcgcctgcggtcccagctactcaagaggctgtggaggggggtccgcttgagcccgggaggtggaggtcatagtgagccgggattgcaccactgactccagcttgggcagcagagcaagactctgnc

SEQ ID NO: 27142 - DNA, 100 bp, Homo sapiens
  misc_feature 4, 10, 32, 87: n = A,T,C or G
cggngatctnacaggaatgtgcctaggaaccngattatcatttaatactgaaacagctgaggaagggacagagaaggtacaagggcnaggcggcacagca

SEQ ID NO: 27143 - DNA, 158 bp, Homo sapiens
  misc_feature 4, 139: n = A,T,C or G
acanacggatacacacacacacacacacacacacacactgcatatctgagcaccgccccctcgcactgggtctcaccttgcaccttcttcaggattttatatgtgaagagatttttatatagatttttttccttttttnccaaaacactttatactcc

SEQ ID NO: 27144 - DNA, 333 bp, Homo sapiens
aggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaacctctaagttgaattcaggctagtgttgcagtatagctttggcatgttcatgagtgagcacccagaatgtgttgaaccaacccccacccctaactactgactatgactgcagtgggt

SEQ ID NO: 27145 - DNA, 469 bp, Homo sapiens
acttgagggaaagattacctacctgccccatcccctttttgtctccccttcctgcggagagccactttgatcagcagtaaaatcgcccacagttaccatgcttcagttcattcatgtgatctcatttttcttggacactggacaaaagctcaggatccattagtgtagatacaaaaaggctgtcacactagttcattgccttcactggcagagggcagctgcctcatgcgaaaaggcaaagggcccactgagctgttaacacttaagtcatctgtggacagcagcgttaaaagagcactgaagcctctggggcttcaggagtggcaggcaatcctgccttggatgctgctgtggggcttatgggagtttgcccctgcctgtgctaaagcatctagctggttccagcacccactcacctgtgtgctccctcctgcaaggagtggaacacagcaagtcttgagtgagtggg

SEQ ID NO: 27146 - DNA, 432 bp, Homo sapiens
ggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcatttttgtggatatagttataatctgatgggcctggctgggagtggaagaagggaagccttttgcaaatagtagagtgtcagttgcaggtgccaatgactaactttttgaattctatgttggcattaacaataaagcattttgcaaacaccc

SEQ ID NO: 27147 - DNA, 307 bp, Homo sapiens
gtttttagatttatatgggaagatagcctaaaatagctaaaacaattttgataaagttggaagacaaattacttgatttcaagatttactgtaaagctgtagtaatcaaaacagtctggtattgacaaaaataaatataaatataaatataaaatatatctcaaaattgatcataaatctacaggtaacaaagctattaaacttgtacatgaaaccatagggaaatgtgtttgttacacgtgttaggcaaaaatttctttaaaagatcattggctaggtgcaggggcaacataacgagactccatcc

SEQ ID NO: 27148 - DNA, 266 bp, Homo sapiens
  misc_feature 6, 61, 78, 87, 113, 118, 238: n = A,T,C or G
aaagantgcaaatgcccctcctgcaagaaaagctgctgctcctgctgccctgtgggctgtnccaagtgtgcccagggntgcatctgnaaaggggcgtcggacaagtgcagctnctgcncctgatgctgggacagccccgctcccagatgtaaagaacgcgacttccacaaacctggattttttatgtacaaccctgaccctgaccgtttgctatattcctttttctatgaaataatgnggaatgataataaaacagctttgacttg

SEQ ID NO: 27149 - DNA, 472 bp, Homo sapiens
  misc_feature 29: n = A,T,C or G
ggagcatttaagaagctcctctgccaagnaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagacattagattctat

SEQ ID NO: 27150 - DNA, 338 bp, Homo sapiens
acacagtttatatttcctggggcggttgtagcttcgcctgaacaggctgtgtataatgaatcttttggatgtcgtcagaggcagggtctgcgtctgtgccttctctattttaaaagcggagtttggctttgtttttaaaagtgctagtcaccagactgcacccttgccagcgcttcgcagctctcgaagtaaattatcgcaggatggcggccctcacctaggagaaccaggaaggcaggcagcgctagaacgacgggattgaattttactattgccaaaacaatcacattcaagtaaggagctgttttgttttgtttttgtttttttaaccaaattat

SEQ ID NO: 27151 - DNA, 158 bp, Homo sapiens
  misc_feature 102: n = A,T,C or G
gctccccatcattggtacccacttgcttttaaaatccactttatcttgaataatgtaagacaaatatgttctgacataagtatttaattcatgttgccttgnataatggtcagaggcgcatgaatttgtgaaggtggaaataaactatttgtaaagtg

SEQ ID NO: 27152 - DNA, 321 bp, Homo sapiens
gaccaacggaacaagttacccttgggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttg

SEQ ID NO: 27153 - DNA, 228 bp, Homo sapiens
tgagcaaggttggagatatagcaaaaaatgtttgtggtgagatatgtaggaggccaaagggacatcaagatagaactagacaatgaggacttaggtaaatgtcagtttagacttaatcacctgtaggagaaatgatgaaagtgggtgtgtcattggggaagtaaggaggtaggaatggaactctaggaagtgtcagttaagacatgaacagaggaaagagagctacac

SEQ ID NO: 27154 - DNA, 475 bp, Homo sapiens
  misc_feature 9: n = A,T,C or G
atataaagnacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaagtttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttcta

SEQ ID NO: 27155 - DNA, 466 bp, Homo sapiens
agctgaacgatttgtgatattttcttgtttttcttcttctctgttgacatttgccactttcagtcccatttccatctccatgtctttctttcatcttgttagagtgcatttatgcctctcaaatttgcctagcgtgctggcaaagaggaacagtctgttggagatgagtgaattacagagtcccatatgatttactttcttcactgtcttggacttggagttaggtggacatgcctctgcacacacccgtgcgaccttgagcaagtctggtgcttactttaaaaggatactgtgaggagtaaagtgttaaaataaaggatttaaagctatgcatggtggtgcacattttgtgatcccaacactttggaaggctgaggtaggagaatcacttgaggctaggagctcaagaccagcctggtcaacatagcaagaccccttcgctacaaaaaaattaaaaaattagttg

SEQ ID NO: 27156 - DNA, 438 bp, Homo sapiens
  misc_feature 16, 18: n = A,T,C or G
cccagggaaactcggntnttatggcccgggcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattg

SEQ ID NO: 27157 - DNA, 227 bp, Homo sapiens
  misc_feature 159, 160, 162: n = A,T,C or G
ctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctnngncccccagctaaggttgaagccaaggaagagtcggaggagtcggacgaggatatgggatttggcct

SEQ ID NO: 27158 - DNA, 313 bp, Homo sapiens
  misc_feature 27: n = A,T,C or G
cagggccgcctggggaacatggtgaanccccgtctctaaaaacaaaaaagttaaaaaattgatcatgcatggtggcatgcaacctgtggtcccagttgcttggagggctgaggcgggaggattgcttgagccccgagaggtcatgattgtaatgaactatgatggcaccactgcactccagctggacggcagagcgaaagtctgtctcaaaatcaaaaaaagattggttctacctcagaaaagaatgtcactgttgacatttcccataatagagaagttcccatttatctttttcctttgttttcagcctccc

SEQ ID NO: 27159 - DNA, 204 bp, Homo sapiens
gttaagaagcagaagaagcctctggtgggaaaaaaggcagcagcttaccaagaaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcaggg

SEQ ID NO: 27160 - DNA, 465 bp, Homo sapiens
gaagaagtggaacacatgtaggaggatataattaagcatgggaggaaaataacgagtaatatgtgaaatgggaaagcaaaatgaaccgggaataaagttcttttttggtttctagtccaaagttaagcttgaggcatttcttgtttactataaccacaaaatatctaatatctgctaactaataactaatacctgctattttaacagatgttaaaataatacctaataaaaattcacctttgcaaggtgctatggaaagttattctttattgagcgcctttagaaacttgattacaaattagaaacagtcaaattaggaaatacaatccttaaatattaaatggaaattttaaataagcatcttgaacagagaatttgaaaaacttttatgtgttctctttgccccactagacccagctctggattacccagttaaaaaaaaaaaatgtaagaataaaacaagtg

SEQ ID NO: 27161 - DNA, 374 bp, Homo sapiens
aaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgcttggtgacagcaaaaatgacccaccaatggaagcagctggcttcactgctcaggtgattatcctgaaccat

SEQ ID NO: 27162 - DNA, 475 bp, Homo sapiens
  misc_feature 12: n = A,T,C or G
gatcacgaaggnggttttcccaggacatctttgaatatggcccaaaagcaattcgtaaactttcttaagacattatgaggttggctgttttttttgtgattcttaaaaatctcatcagctatcattagtgttagtgtattttatgtgtaattcttcttccagtgtggccagggaagccaaaaaagattggacacccctgatctatgataaaaattatttaataataataataataatatgctttaagcatattacaaactagaaggcctcagtaaataaactgaaattctcagcaaagaaatagaagttataaaaaaatggaaactttaggactgaaaaggacaacatcaaaaaggaaaactcagtggatgggctcaatggcaaaatcgataagatggaagaaaccactaagtcagtgaaatagaagacagaacaacagaaattacctaatctgaacagcggagagaaaacagac

SEQ ID NO: 27163 - DNA, 418 bp, Homo sapiens
  misc_feature 9, 10, 291, 310, 312, 341, 369, 385, 401, 409: n = A,T,C or G
aaccccagnnggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtnccaaataataataatgctntncttaaatacttgggaaaacaacccatttnaagattccgtgctttttggacaggtttngaatgacagttatcgnctgctggtagggggcnttctaaanaattttttt

SEQ ID NO: 27164 - DNA, 402 bp, Homo sapiens
aggaaaagtggagttcaaaatatccaattggagaaaaattcagagttccttcattaaatataatttttttcatctagtatgtactatttcaagaagtgcaaaaagtaatgatagtgaatgtgataccatacttaactaaggtaatatatatccttagtttgctcaaaagagtcctggttattcctgttttctcagcttaatagtgcctcatcgtactctcaaaagtgttctaatttggaggataagttatatgatcatcctgtgtataattgtagactgtaccaagaagcaactaccttagctccactgccctttgagggatggaactggggtaagggcaggagccagttattattgccacagtgttttctaatgaaccatttggcctgtagaagaggaata

SEQ ID NO: 27165 - DNA, 440 bp, Homo sapiens
  misc_feature 141, 439: n = A,T,C or G
aggagaagagctaatcacaggtgaccactcaagttctttcaatgaagacctgatgatgtatttagttcccattttccacggtgattgactcaatttaagtgtattgtggctatatgtaatttacaggctgctttgcgttgnaggtgggaaaatctcccaggctggtgtgaggctgaactggggtaaaagaccccctgacccctcctcattcttctaaggtcaccacctcttagagggtctcttattttctttcagagatcaaatgcacagttatgctgtacaactaaattctgcagtcttgggaatccttacgagtaccaactattagtcactttttaaagtccccaaagtggagtgaggatagggggagtggaagcagtgtttggttcttactttacccaaactgtgtataaagaataaagttagcagaatgatgccnc

SEQ ID NO: 27166 - DNA, 426 bp, Homo sapiens
  misc_feature 1: n = A,T,C or G
ncagcagctctattgaataacatgcatctgaattttaagttgcaaaggtatctgaataatttttcatgtgcgtcttttgtcgaatgttttggttcaagaaagaatgtttaaagctttttaaaagacttcagttcttaatgtaactgtacccttctgcatggaaaatcataaccaacgtggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaaatga

SEQ ID NO: 27167 - DNA, 226 bp, Homo sapiens
  misc_feature 222, 223: n = A,T,C or G
atgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtnngga

SEQ ID NO: 27168 - DNA, 463 bp, Homo sapiens
  misc_feature 12, 21: n = A,T,C or G
acaacaacaagncttaccagnagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaag

SEQ ID NO: 27169 - DNA, 462 bp, Homo sapiens
  misc_feature 64: n = A,T,C or G
gcctctttttccggctggaaccatggagggtgtagaagagaagaagaaggaggttcctgctgtnccagaaacccttaagaaaaaagcgaaggaatttcgcagagctgaagatcaagcgcctgagaaagaagtttgcccaaaagatgcttcgaaaggcaaggaggaagcttatctatgaaaaagcaaagccctatcacaaggaatataggcagatgtacagaactgaaattcgaatggcgaggatggcaagaaaagctggcaactttctatgtacctgcagaacccaaattggcgtttgtcatcagaatcagaggtatcaatggagtgagcccaaaggttcgaaaggtgttgcagctttcttcgccttcgtcaaatcttcaatggaacctttgtgaagctcaacaaggcttcgattaacatgctgaggattgtagagccatatattgcatggggggtaccccc

SEQ ID NO: 27170 - DNA, 197 bp, Homo sapiens
aagaaatcttttttcttttttctttgcttctgttctttgtgatctaagataagttgtcatctctgcaaacaacttgttatatctatgttttttataagcctcatggtaaccacaatgcaaaaatctgtaatagattcaccaaaaattaaaagcaacaaactaaaatatactaccagataaagtcacttaacacaaag

SEQ ID NO: 27171 - DNA, 370 bp, Homo sapiens
  misc_feature 54: n = A,T,C or G
aggcattgtttttaagaaaaacatgtcatgtaggttgtctaaaaataaaatgcntttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaacctggaagagattaccaagagaataaaaagagactcattcagtgg

SEQ ID NO: 27172 - DNA, 465 bp, Homo sapiens
gacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttatt

SEQ ID NO: 27173 - DNA, 331 bp, Homo sapiens
  misc_feature 6, 11, 42: n = A,T,C or G
tatgtnctagnaccaaggggtaggttccgggtctgcaaaagnacatagtgtgccacccacaaacacacaacttcaaggagcgtggctcaatccttcagaaaattggttctaactttcaaatcattagggatcttctttatgaaagatatagcaaacaaaaacacaaaatatacccctctaagattattaggaagttaaaaaaaagtgacttgtaacttttaataaataactagggaggtaagcttgttcatttctgagattcacaacttttataaaggtgctgtattaatacttgaattgtgctatgttcaatagaagcagagacataagc

SEQ ID NO: 27174 - DNA, 433 bp, Homo sapiens
  misc_feature 6, 7, 24, 32: n = A,T,C or G
cagctnnatgcagaggtacagagnagatcccngaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttga

SEQ ID NO: 27175 - DNA, 294 bp, Homo sapiens
cgaccatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcagaattccttgggatgtcaattggggtgcacaacatagggcagggctgtgtctcatgtctagactatgatgaacattacattctcacat

SEQ ID NO: 27176 - DNA, 100 bp, Homo sapiens
aaaggaaaagactcatatcaacattgtcgtcattggacacgtagattcgggcaagtccaccactactggccatctgatctataaatgcggtggcatcgac

SEQ ID NO: 27177 - DNA, 177 bp, Homo sapiens
acatttttttcttttaggaaatatcatttgtggcaggcgtcaaccccattttatttgtccttattcctgtggaagcagtatatgttttcttcctgaatgctcattaggacttcttaaaaaacatgaaagtaatttggaagtaagtttatccaataaagcagtatttctacccttttg

SEQ ID NO: 27178 - DNA, 423 bp, Homo sapiens
gcttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctg

SEQ ID NO: 27179 - DNA, 386 bp, Homo sapiens
  misc_feature 7: n = A,T,C or G
gaaatcngctgcctgttgtgagagggcctgtgtagggagtcacgcagtgaggacctgaggacagcctctgggagttgagaacaatctccagatgacagccaacaggaaagtggggacctcagtcatacagccacaaggaagtggattctgctgacaacctgaatgaacttgaaagcagattcttccctacttacacctccctgtaggaatacagccaagttgacagcttggtttctgccttgtgagaccggggactggttccagtgcctggactcctgagccatggaaactgagagaatgtgtgtttctttaagcctccaaccttgtagtaatttgttacacagctatagatacctaatacagtatcattaatttaaatttcaact

SEQ ID NO: 27180 - DNA, 166 bp, Homo sapiens
  misc_feature 33: n = A,T,C or G
agatgaagaagtagatgaaatgatcagagtaancagatattgatggagacggacaagtcaactatgaagaattcgtacagatgatgactgcaaaatgaagacctactttcaactcctttttcccccctctagaagaatcaaattgaatcttttacttacctcttac

SEQ ID NO: 27181 - DNA, 474 bp, Homo sapiens
cgcacctcttagtcgcgggctgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggacacagcattgttggttttgccatgtactattttacctatgacccgtggattggcaagttattgtatcttgaggacttcttcgtgatgagtga

SEQ ID NO: 27182 - DNA, 223 bp, Homo sapiens
  misc_feature 31: n = A,T,C or G
gaggccttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatg

SEQ ID NO: 27183 - DNA, 370 bp, Homo sapiens
  misc_feature 239, 285, 311: n = A,T,C or G
gttgctctgtgcctgttgaatgtccatgctacaagaagttatgagccttgttctaagtacagatgagccttgtatttgtgtaatctcccaagggagagctatggtttacattcaattttttggtctttctgctatgaaacgtgtttattttgcctctgtcaatgtgtttgcaacccttaagtaaggaaagggaaaaaaaaaatagccctctgaactctgatcttttgccgcttctgtanattttgattgtgaagttgggagtgaggacattcaaaagcccatggngaatgcatatgcctttagaatattgngcctgttttaaaatgtttgagcttttaaaatacgttgttaaaacatgaatccatttttg

SEQ ID NO: 27184 - DNA, 396 bp, Homo sapiens
  misc_feature 2, 18: n = A,T,C or G
anattccctgtcactagnataaagaggctctagcttggtgggtcctcacagggtttggctaaaagagccctctcaaagcccagtttctactttctctgagaaagattttaaaaggaatatattgtgttttttaaaattactacaaaaatagattcatggcatatcctagactcttgaggtagaaggtttttgtttttaaactttgttttcagtttctggactgcaagatctgttttttcagatttccaccgagacagagccacgtgtatattgtatttatatgagcaataaaataacacaaaaccccaaagaggggaaaagctgggttacttctatacttctatgcttagttacagttttatttaaagtatcaagttttgtgaatgtttgttctgg

SEQ ID NO: 27185 - DNA, 186 bp, Homo sapiens
  misc_feature 6: n = A,T,C or G
atcttngcagctgagtacttaaattctttttaaaaagataccctttggattgatcacattgtttgacccagtatgtcttgtagacacgttagttataatcaccttgtatctctaaatatggtgtgatatgaaccagtccattcacattggaacaactgatggttttaaataaactaattcactatt

SEQ ID NO: 27186 - DNA, 378 bp, Homo sapiens
gatcttcaggcctgttactcacagtgtgctccaccatcctgcagcatcaacatcacctgagaacttgggagaagtgcagaatctcaggccataccccagaccgattgaatagttcccgagatgatttgaatataatggttccaatatctgaaaagctggtccgaatacaaggattccacattccaataattctcaaacttaaacatatatcaaaatcacttgaaagacttctgaaaacagatcgccgagtctccctcgtagggttttggattctgtgtctggagtggtgcccagtcgtttgcatttctaacaagttcccaggtggcacggggaccacagtttgtgaaccattgctacagtcaaataaatgaggaaact

SEQ ID NO: 27187 - DNA, 489 bp, Homo sapiens
  misc_feature 1, 7, 28, 30, 31, 109, 116: n = A,T,C or G
naaagcngtagctgtgtagtctccttcntnnctgctctaagggggctggcaacatggctcagcaggcttgccccagtagccatggcaaagaatggacttgtaatttgcntcctggngatcaccttactcctggaccagaccaccagccacacatccagattaaaagccaggaagcacagcaaacgtcgagtgagagacaaggatggagatctgaagactcaaattgaaaagctctggacagaagtcaatgccttgaaggaaattcaagccctgcagacagtctgtctccgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtc

SEQ ID NO: 27188 - DNA, 488 bp, Homo sapiens
  misc_feature 5, 31: n = A,T,C or G
gaaanataggataatatgtagctaagagtanccttggagttgcctccccagcccttgttcttctcttggtaactaccatgacttttgttagggtatccacatctcccccaatagaccactccactcctgaagactcaggcctagtgcaattccattttaaggccactattacaggacccagtgatgggtgctggcctaattcaggccagtgagcttgcataagtttattggcttatttccagaaaaacaaatttcctttttcctgctagataagaatgggacacatatgtggtctcactagcaattcaggccaatgagtttgcataagtttactggcttatttccagaaaaacaagttccctttctcctgctagataaaagtgggagacatatgcagtctcagcagcaatagaaagccactctgagactaaaacaggggcaagccctagatggaagctctcattgtgaatggcagagtggagtgatgg

SEQ ID NO: 27189 - DNA, 341 bp, Homo sapiens
  misc_feature 6, 32: n = A,T,C or G
aacgancaaactggactttttaaaccctcttnagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttac

SEQ ID NO: 27190 - DNA, 458 bp, Homo sapiens
  misc_feature 4, 28, 29: n = A,T,C or G
cgcnatagatatagtaccgcaagggaannatgaaaaattataaccaagcataatatagcaaggactaacccctataccttctgcataatgaattaactagagataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 27191 - DNA, 410 bp, Homo sapiens
  misc_feature 31, 179: n = A,T,C or G
ataatgactagttatattctttgtcctaccntgttgctgacttacaaatccaaactatagttatgtactagcatcaaaaaatttaataaataaaatggagacaatgtcagagcttatatacacattaaatggtctccccttactaccatactctgattacattaaatagtaccagaggnatggttaattttcactcaaaaataccactgtaattttctttatttgtgtaattaaactagaagatctgcagcacattaaaacagagctgaaataagattgcttaaatgacagcgttttgctttggggcaaataaaacatttctggaaaattcattatctcttaagtaggcattgttcacagattataaaaatgcttatttatttcattaataagattggatcttatatgtg

SEQ ID NO: 27192 - DNA, 106 bp, Homo sapiens
cgcaggaactgtgtgtgtcctacacaatggtgctattctgtgtcaaacacctctgtattttttaaaacatcaattgatattaaaaatgaaaagattattggaaagt

SEQ ID NO: 27193 - DNA, 471 bp, Homo sapiens
ctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttg

SEQ ID NO: 27194 - DNA, 467 bp, Homo sapiens
  misc_feature 11: n = A,T,C or G
cacctcttgtnagaaaaataaagccctgggatttgaatcctggtgagaagcaataatgtgaagcttccaaattccattgctctgtttttattgtgtctgtcttattttagaaacatatgttttaggatgtactgtgtaaatgccagtttcaattttacaatggaaagtgaaaaacagtggcatgagaaaatgtatatttcacttatatgtatggctttcccaaggacatgtttcactttcagtggatttcacagtttttttgttattttattttatttttttagtgacatagccttggagtaatgttaagttactcataaagaagggattttaatgaatatctgtggaagatactcttatttattgctggtgcctttctttcactaactaaatgttatagccagtctctggagcacatcatgatactgaaccagtttttcatcaccagtttccattctcttttgagc

SEQ ID NO: 27195 - DNA, 435 bp, Homo sapiens
  misc_feature 9, 23: n = A,T,C or G
acgatcagnagggatgagacagnacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttaggtttgttcttcagattgatagggagttttaaagaaattttagtagttactaaaattatgttactgtatttttcagaaatcaaactgcttatgaaaagtactaatagaacttg

SEQ ID NO: 27196 - DNA, 207 bp, Homo sapiens
  misc_feature 76, 78, 100, 112, 129, 158, 180: n = A,T,C or G
ctcagcctgccgagtagctgagactacaggtgcatgccaccacgtgtggctaatttttgtatttttttttttgtananatggggtttcaccatgtttctnaggctagtctcnaactcctgggctcaagngatccactcaccttggcctcccgaagctntgggatcacaggcgtgagcgantgcccccaggggaaggaattaatcttt

SEQ ID NO: 27197 - DNA, 130 bp, Homo sapiens
agaaggttgatatgcacctgtacagtaattcactcccccatttcacatctttgtcagagaatagttcttgttcatactgagtgttctaaatttgaagttatatatacaaattaaaatattttaaaaattc

SEQ ID NO: 27198 - DNA, 316 bp, Homo sapiens
  misc_feature 7, 10: n = A,T,C or G
aggctantcnagttatggcaactccgacaacacgcacggaaagagggggctataagacccaactctcgttatggaaatacttatggtggagatcaccattcaacgtatggcaatccaagaaggcaatatggtagcaaaaatcgtgtctcccatcgtatccgtggtggtggtgacacttgctgggagcagcagccagttatttcaaactaaacaataggagaaattgtttcaggacccatgaaccagaaaatgtctgaagatgttaagatcccctgattactttgagaaaaacaactaaaacaagaaccgtgtttat

SEQ ID NO: 27199 - DNA, 151 bp, Homo sapiens
  misc_feature 83: n = A,T,C or G
agaaatgagcagttactgatgtagaacagggtttgacaatttttttcaataaagggccaaatagtaaatattttaggctttgnaggccacatactccctccttcacctcctcttgcctcctccctctcctcttctccttcaacagtccttt

SEQ ID NO: 27200 - DNA, 340 bp, Homo sapiens
  misc_feature 8: n = A,T,C or G
gaaaaccnttgtggaattgcctcagcagccttctaccccactgtgtgagctggtggacggtgatgaggaaggacttgactggggatggcgcatgcatgggaggaattcatcttcagtctaccagcccccgctgtgtcggatacacactcgaatcattgaagatccgggtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgtagtggtg

SEQ ID NO: 27201 - DNA, 487 bp, Homo sapiens
  misc_feature 20: n = A,T,C or G
tgacggggggcaaaaaaaanaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaccagaaaattggaaatcatagtcaaagggct

SEQ ID NO: 27202 - DNA, 240 bp, Homo sapiens
  misc_feature 223: n = A,T,C or G
gtttcactgaattctctgcagccccttttcccacagatgtttcagccaaacctgtatggagggaggtgacatggcatggcttgctgtttaaaacagctacggtattttgtgcttcccttttgagtgtgtcaaggtgaacaaaaggagagcctctagaacgcatgggagggaatttggggacaggaccttttacatgctgggggaaactgacaggactcagggnggaaagactttggttgg

SEQ ID NO: 27203 - DNA, 473 bp, Homo sapiens
gcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttaaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataatttttttgtaatgt

SEQ ID NO: 27204 - DNA, 236 bp, Homo sapiens
gaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagg

SEQ ID NO: 27205 - DNA, 393 bp, Homo sapiens
actcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttaga

SEQ ID NO: 27206 - DNA, 350 bp, Homo sapiens
cactccgcgtcgatgccaccggcctgtgggtctctgaagggacccccccccaatcggactgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactg

SEQ ID NO: 27207 - DNA, 454 bp, Homo sapiens
tgcacactgcatgtttatagcggcacaattcacaatagcaaaattggcacaattcgcaatagcaaaaccaacccaaatgccatcaatcaacgagtggataaagaaactgtgatatatataaatgacggaatactatgcagtcatgaaaaggaatgaattaacagcatttgcagtgacctggataagattggagactattattctaagtgaagtaactcagttatggaaaaccaaatatcatttgggagctaagctatgaggatgcaaaggcataagaatgatacaatggactttggggacctgggggaagattgggagggtggtgagggataaaagactacaaatacgatacagtgtatactgctcgggtgatgggtgcaccaaaatcttacaaatcaccactaaagaacttattcatgtaaccaaataccagctgtaccccaataacttatgg

SEQ ID NO: 27208 - DNA, 464 bp, Homo sapiens
accactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcacgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattac

SEQ ID NO: 27209 - DNA, 479 bp, Homo sapiens
caaacaccctttattcgaatgtcctgggagtaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaaggtagctgaatggtttttttttaaatgagtacaactctagcattttgaagttccagttgtaaatgtatttgtttaccagtaggtttgtga

SEQ ID NO: 27210 - DNA, 444 bp, Homo sapiens
aacgcttaaatatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtctttgtattatgtatcctttttgtatgggaaagactatattttgtacttaaccagatatatttttaccccagatggggatattctttgtaaaaaatgaaaat

SEQ ID NO: 27211 - DNA, 457 bp, Homo sapiens
  misc_feature 16: n = A,T,C or G
cgacaaacctaccgancctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcat

SEQ ID NO: 27212 - DNA, 134 bp, Homo sapiens
aactcacaactcactgcagcgtcaacctcccaggctgagtgggaggatcgcttgagccctggagatcaaggctgcagtgagcttgatcgcattcactgtactccagcctgggcaacaaagtgagaacctgtctc

SEQ ID NO: 27213 - DNA, 232 bp, Homo sapiens
aagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctc

SEQ ID NO: 27214 - DNA, 489 bp, Homo sapiens
  misc_feature 6, 18, 20: n = A,T,C or G
agagtnaatacaccaagnanctacagctactgacttgtatgaaataaatcatcagtcttaatgatagctctttgagttacattgatgggtgggctcactgatacacaccacacaactctgggtgtgtgtgtatgtgtgtgtgtgttgtgggggcaggatcacttgccctcgcaacctgaggatctgaaccaaccaggaacctcaggaaaaaaagggctgctatgggctgggcgcagtggctcacacctgtaatcccagcactttgggaggccgaggcgggtggatcacgaggtcaggagtttgagaccagcctgaccaacatgatgaaaccgtctactgaaaatacaaaaattagccgggtgtggtggtgcgcacctgtaatcccagctactcaggaggctgaggcaggagaatcgcttgaacccaggagatggaagttgcagtgagccaagatcgtgccactgtactccagcctggaggacagagcat

SEQ ID NO: 27215 - DNA, 468 bp, Homo sapiens
  misc_feature 11, 26, 60: n = A,T,C or G
gacataatagnagatagaaagccagnaaggagcgtggatcggaagagaagggatacttcnggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgata

SEQ ID NO: 27216 - DNA, 380 bp, Homo sapiens
  misc_feature 1, 11, 42, 352: n = A,T,C or G
nctgattccangccttttctgggagcaaagccagggcctggngcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctactttgatgatgggaaatgctttcactttaccagctttgggaagcagcagccccatgggatctaaaagtgtggagtctgcattaagaaacctacatgggtggcatggggctctggggagcaagcccttacttgctcagcactggntatgtagcacaaatagctcctaggaaaa

SEQ ID NO: 27217 - DNA, 162 bp, Homo sapiens
  misc_feature 124: n = A,T,C or G
aaccgctcacatgcataacaataatgctagtaaattcaggaattataattttgtgatttatactgtgtggtaaattattcagttctcactgcaaataaatataatgtatatcaatgtaatgtangtcagaatgtctatggtgagcaaataaaagattatttt

SEQ ID NO: 27218 - DNA, 413 bp, Homo sapiens
ataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgt

SEQ ID NO: 27219 - DNA, 282 bp, Homo sapiens
  misc_feature 27: n = A,T,C or G
tcagcaaaaaatgaaatatcatcaagnataatgaactctgaatcctctccagaagtttctggtatattttctttaactacttacaagtttacacaaaacttacccgtttgtgttgcctagcaagtttctctttagcttcttccagctctttctggatcttcaggacatgtttgttcatcttacgaattgtagagtgcaaaatttcccaaacaaacaatcttaaagaaatatggcatttggttactgtatgtcaagctatggttacagaaaataaaatctttc

SEQ ID NO: 27220 - DNA, 200 bp, Homo sapiens
atttaggggaggttttagagcttaattttacagggcatgaagctcagatgaggtttccttagcgaaatacagacccagcccctggacttctatttattactgatctttaagctttatcagcccaatagtcaccaagagagctgctctgtatgttttttaaaaatcacagaaagtacaaaataaaggtgatattaaacgac

SEQ ID NO: 27221 - DNA, 468 bp, Homo sapiens
tccccctggccctcctggacctccaggtgtaagcggtggtggttatgactttggttacggtggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaaggagtgacttccaagg

SEQ ID NO: 27222 - DNA, 240 bp, Homo sapiens
gatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaagt

SEQ ID NO: 27223 - DNA, 465 bp, Homo sapiens
  misc_feature 6: n = A,T,C or G
gtagcntcatggactttttggaagatcgggtaggcaggagtcaaaaataaaaccccatttatgctctaggactggtggtaaaaaataaataaataaaaatttttaaaaagagaaaagaaaaagtgataaaataaaaccccagtaattcatcagccttaattatatcagttggttcatcacctccagccaacttcttagagccagctttcctggagaaagagaggaggatcccttgatcattgaagcaagttagctgcttatacccagaaatctcagtgtaccacccccaccaaactctcttgccttttccatattccaccaactagccaacaacattagaggtaagaacacctccaggttttctggttaggaaattgggtgggccaggtgcagtgattcatgcctgtaatcccagcactttggggaggctaaggtgagaggattgcttgagcccaggagtgccag

SEQ ID NO: 27224 - DNA, 374 bp, Homo sapiens
  misc_feature 27, 33: n = A,T,C or G
gatgacatcacctattggcttaacagnagtatngaaatggacatgaatactatggcgattactaccagcgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttggc

SEQ ID NO: 27225 - DNA, 385 bp, Homo sapiens
  misc_feature 10: n = A,T,C or G
gaagctcagnaggagatgggcaattgacagggatgcaatccagggtgggatttcttgaggaagttacaaataagcttgttacaacatcaagatagatggaattggaaggatgctaccaggagagtacttacatagtgctcaggagtttctcttcttaaaatgtttactgctgaaagatgagcaggaccagggcgttataggcagagccctagccgagaaacctgctggcctctgcctgttttcatttcccactttggttgtgtggcattactttcagaattgcactttcctgcttgtcatgactttttgacacacttgccatgacgtgtgtttctgtgaacatgaagttctgcggtagtgcctccaggggcagaggaaaagaaga

SEQ ID NO: 27226 - DNA, 322 bp, Homo sapiens
agttcaaatcctggctaatgactaaacttacctttgggaggtaaaaggcagagaagaatcatatctgttttctaagaaggaccttagaagattaagatgaaacaatgtataaaaacaaagtagcttatacttgcataactgggcagttcactgtttttatcagtataatcctttttttgcaatagcaattcaaagagcttttccagtggttgaacagcagtcatgggtttaaattatgtttgcttataaccacaagaatctttatagagaacaaaatgtttgtactctggactatcctagagaattctacgaacatagactg

SEQ ID NO: 27227 - DNA, 176 bp, Homo sapiens
  misc_feature 13, 44: n = A,T,C or G
aacaatagtgaanctagttcagtagcccagaagtggatctgaanccaaagtggaacctaaaaaatgtgaactgtcaaagaactctgatgtcgaacagtcttcagatagcaaagtcaaaaatctctttgcttcctttccaacggaagaatcttcaatcaactacacatttaaaacat

SEQ ID NO: 27228 - DNA, 365 bp, Homo sapiens
  misc_feature 345, 364: n = A,T,C or G
gaacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcggaacagagatggcttcatcgacaaggaagatttgcatgatatgcttgcttctctagggaagaatcccactgatgcataccttgatgccatgatgaatgaggccccagggcccatcaatttcaccatgtncctgaccatgtttggtgana

SEQ ID NO: 27229 - DNA, 475 bp, Homo sapiens
gagaacccacagcactttggcgtcgctgttccacataccaccaggccccgaaagagccatgagaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacgcagcagccccatttgatgagcagcagcaagagatggccgcttctgccgccttcatagaccggcattacgggcacctggtagacgccgtgctggtgaaggaggatctccagggtgcctacagccagctca

SEQ ID NO: 27230 - DNA, 454 bp, Homo sapiens
cctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagctttcttcgccttcgtcaaatcttcaatggaacctttgtgaagctcaacaaggcttcgattaacatgctgaggattgtagagccatatattgcattgggggta

SEQ ID NO: 27231 - DNA, 155 bp, Homo sapiens
  misc_feature 6, 155: n = A,T,C or G
gttaanatacccttttaaatatctctattggcacagcaaagtaagcttttcagtttagtagctctctaacaaaatattttctaattctgtgctttaagtgaaataaaacggggatgaaagtggcaaaaccatattatcatgtccatgagcggccn

SEQ ID NO: 27232 - DNA, 450 bp, Homo sapiens
caccttaaagaactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaag

SEQ ID NO: 27233 - DNA, 476 bp, Homo sapiens
gcaagcagagtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataata

SEQ ID NO: 27234 - DNA, 395 bp, Homo sapiens
  misc_feature 1, 237, 271, 296, 368, 370: n = A,T,C or G
ncatgccattctcctgcctcagcttcccaagtagctgggactacaggcgctggccaccatgcctggctaattttttgtattttttagtagagacggggtttcaccatgttagccaggatggtcttgatctcctgacctcgtgatctgcccacctcagcctcccaaagtgctgggattacaggcgtgagccaccacgccgggcctgtttacttttttacaaaagtgggattgtgtcgnaaatatgtcatagacaattgctgggtttccaagngcatttgtctcctttcctattaganaatgtcctctgtatgtctatttgcaagatcacaccagttatgaggaaccaggaacttggccatcactgtgananagaactggagcaggggcctagctga

SEQ ID NO: 27235 - DNA, 483 bp, Homo sapiens
  misc_feature 11: n = A,T,C or G
gaaatttcagnatggcattgccgagaaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctgggtaagaaaattgtttttggttacgatgcatttcagcttgatggattcttatcatttgctctttgtatgtgtttatgtatgaatctaaattaattgacaaaatat

SEQ ID NO: 27236 - DNA, 247 bp, Homo sapiens
caagcaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcattttt

SEQ ID NO: 27237 - DNA, 474 bp, Homo sapiens
ctattagctaagacttaaagtccatttcccataaaaatctgctgatgttccctgctaacatttgctccagcattttttctttctaattataaaggtaatacaggggttgtagaaaatttggaaaatagggagaagacaaactatcaataacttcatcacattggagtatgtgtatttaagatctgtgtatatattctttcacgcttaaaaagttttaattaaaataggaaagaaatgacacagcagattagtagtgaaaattatgaaaatcagtaaaagatttttttttaagggcatgaaggatgagtgggatttataaaatatgtcaaaatacatactaagggattggggattttcttccaagtgtagtgatcaacatgcatagaggcagagaagggcaggctctatttgggaacaatgaataatacagttagactgtgtgtagggtagggtgtatataaagcagtggaagat

SEQ ID NO: 27238 - DNA, 334 bp, Homo sapiens
  misc_feature 41: n = A,T,C or G
gatcgtcaggtgggataatccttacctgttcctcctccggngggcagattagaacatgatgattggagatgcatgaaacgtgattaacgtctctgcgtaatcaggtcttgcaacaccctgattgctcctatctgattctttctgacgatcacttacatttgtgttatgctgattagcagatatccacaaacatagctatgaagttctgactgggataaccttgctgtttgtctattttgcagtcttgctattactgtttgtctattttgcagtcttgctaaatttgtttgttcttgaaaattgtgatttggtttttgttgctttctggaattta

SEQ ID NO: 27239 - DNA, 377 bp, Homo sapiens
  misc_feature 140: n = A,T,C or G
atgtatgtgtgtttctggttttaataacagctttattcagatgtgtttatttaatgtatcaatatctttctactagataacagctttattcagacgtgtttatttaatgtattcaatatcttccaagatcaaggcgctgncaggaaaaaaaaattttaagtattaaatatcatacaattcagcaatttaaagtatacaattcgatggcttttagtgtatcacagagttgtgcaaccatcatcacagtcagttaagaacatttcatcacctcagaaaagacaccttgtgttgtgtagcagcgtgaatgtactcaatgccactgaactgtacacttaaaaatggttaaaatgctaaattgtgtattatttatagtttac

SEQ ID NO: 27240 - DNA, 471 bp, Homo sapiens
  misc_feature 12, 32: n = A,T,C or G
gcctcttttacnaaggacccgccaacatgggncgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttaccgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatc

SEQ ID NO: 27241 - DNA, 400 bp, Homo sapiens
atctttaaaaaggaaattttattattttccatcacatgaatgaacttggaggacattatatttgtcaaaatgagccagacacaaagattattatttcatgatttcacttacaaagggattctaaaaaacttaatcttattgaagtagagagtaaagtggtggccaccagacaccaaggtatttaggagacaggagggtttgaaaaggtgttgatcaaaaaatacataattatagttaatagaagttcaagagatatttttgtacagcgtagtgactatagatcaaaataatgtatttgtaggttttgaaaaatgctgacaatgtcacttgctcttgccacagaaatgttaactatgtggcgtaattacctagaattaagcatttaacaatgtatatatac

SEQ ID NO: 27242 - DNA, 475 bp, Homo sapiens
  misc_feature 201, 360, 448, 449, 451: n = A,T,C or G
acattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaaatncttataaaattacatattctgaaagaggattccgaaagatgggactggttgactcttcacatgatggaggtatgaggcctccgagatagctgagggaagttctttgcctgctgtcagaggagcagctatctgattggaaacctgccgacttagtgcggngataggaagctaaaagtgtcaagcgttgacagcttggaagcgtttatttatacatctctgtaaaaggatattttagaattggagttgnngngaagatgtcaaaaaaagattttag

SEQ ID NO: 27243 - DNA, 315 bp, Homo sapiens
atagcgggacattatctctacaaaaataaaaagaaaaaatagtcctgcatggtggcacgtgcctgtaatcacagctactcaggaggctaaaatgggaggattgcttgagactgtgagtttgaggctgcagtgaactacgcctgtgccacttgtactccggcctgggcaacagagagaaactgtctcttaaaaaaattttttttaacttaaaaaatagaaaaacaaacttacatttccattgctgtgcgtacttgttttgaaagcagatatgatgtcctattttactgtgagctataaatttatttctaaaccctc

SEQ ID NO: 27244 - DNA, 487 bp, Homo sapiens
  misc_feature 31, 34, 132: n = A,T,C or G
atactaaatgggctccttcatggtgacgccncgncaaccacaatcaagaactgaggcctgaggctggttgtacaatgcccacgcctgcctggctgctttcacctgggagtgctttcgatgtgggcacctggncttcctagggctgcttctgagtggttctttcacgtgttgtgtccatagctttagtcttcctaaataagatccacccacacctaagtcacagaatttctaagttccccaactactcccacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccag

SEQ ID NO: 27245 - DNA, 214 bp, Homo sapiens
gcaatggaagcatatcaaatgccgaggagacaacaaggaaagggaggaaaggaattcaaagggacaggaaagatttaggaggttcactatcttgatgtgatgatggtttcacaggtaaatacacatatgtccaaactttttgagttgtacgctttaaatatgtgcagcttattgttaattatttcttaacagaacactttttaaagaaacaaag

SEQ ID NO: 27246 - DNA, 472 bp, Homo sapiens
  misc_feature 33: n = A,T,C or G
gctaaacctagccccaaacccactccaccttantaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgta

SEQ ID NO: 27247 - DNA, 190 bp, Homo sapiens
  misc_feature 7, 24, 33: n = A,T,C or G
attcaangttacttgtaacaaagnactggattntaatatgaacacatctggatttggggaaatgtgtacaaatatggctatatgtaaaggtagcagcagtttatagctttccttattagacttctgtctatatacttcaggcaggagtagaaaaagcccatggcatattgagctagtatgtgtccttact

SEQ ID NO: 27248 - DNA, 346 bp, Homo sapiens
  misc_feature 343, 345: n = A,T,C or G
aacaacaaaaattaagaaatccctgacttttgtagaattcccactgtcaaattctcactgacttatgagtgtgagagaagttatcttttgtttgaattctgatagaacagtttaactcctttctaaggatataaaaaattcattggaaagtgtgtatatttcaaagactctcaattatctggactgaaggcactgttctcactatggccagatgaatgggagtattctgtacatgaatcatgctgtattttaaatcaggacatcacttaagtattaatgttgtgtgtacagatttttgttttgggattttttttgcctaaataaatgttataaattttaaaanang

SEQ ID NO: 27249 - DNA, 246 bp, Homo sapiens
  misc_feature 208: n = A,T,C or G
gtcctcagttttaactgaaattatcctttgaaacactgagaatgatgcctggcctggcaaactctaaaaaaacattaggatgaagaccctctacacctcgctgtcagaaggcttttgttgaaattctgtctggctctaaaatccatccttgacctctttgacactctgcctggcatcttaggaaggttccattaacagttaataaggngaaactcaggaacatacttttttaaaaataaacatacc

SEQ ID NO: 27250 - DNA, 500 bp, Homo sapiens
  misc_feature 16, 22: n = A,T,C or G
gtatcacggcctcacngtgccnctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtaccgactccacaaaacgattatgtactctt

SEQ ID NO: 27251 - DNA, 486 bp, Homo sapiens
  misc_feature 32: n = A,T,C or G
agatatcaataatttccaaatgactcactttngcgcacaccaggttttcctctgggcgtctcctcctttcaggctcctacagctgcaaattcaccacattcaataataagacaaaaactttctctgatgctgttaatttttaatgtgctggcagattaaatctattactttcaataactatgcaaactttttgagagcaagagaatgtatgcagaaagaaattttccctgggaaggaaaaaatatggcctagattggatgttttcaaggcagttcaaggcccttggcagaggtaacacagatacctgtgggccatgtgtgggttttggtgaacccaggaagtatgtcagtaatatgcatctgggtatcaggtaaagaattacagatgctgtttagattttcatctaggttttggagaagcaagctttatattaagaaaccccttccctcttggccttctctcgccaatagaaacattgttttagga

SEQ ID NO: 27252 - DNA, 480 bp, Homo sapiens
  misc_feature 28: n = A,T,C or G
aagtagagcggaggtggtggcggcggangctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactg

SEQ ID NO: 27253 - DNA, 411 bp, Homo sapiens
gaaaacaatggaagtcaacatctttgcctaacttttttatgtttccaccaaaatcaagtcagatttctaatatcttttagtgaaccaagatgtctctctcttgtgcctttagtaatgtgagtaagcagaaaagaatgagggagagggctcatgtgactgtatggatgaatttccacctctgagtaatggagttcccgggcaagagttttctggaggcagtagtcttttgcgccaccccaaaattaaatgatctccaaacagtaaaaataagtatttcttagaatatcctctactgtagtgaagtggcatcattgtctggggtagtacctgaggttcatcgtctcatgtcaagaaaattaaggacacggacacacacaaggaatgaatttaggagtggaggtttactaggac

SEQ ID NO: 27254 - DNA, 169 bp, Homo sapiens
  misc_feature 31: n = A,T,C or G
atagccgaatacacaaacattattataatanacaccctcaccactacaatcttcctaggaacaacatatgacgcactctcccctgaactctacacaacatattttgtcaccaagaccctacttctaacctccctgttcttatgaattcgaacagcatacccccggattt

SEQ ID NO: 27255 - DNA, 320 bp, Homo sapiens
  misc_feature 6: n = A,T,C or G
cacacngggatcctgcgggagaggtaagtttagctgatgggagtggaagatccagcccattcttcgtggtgcctgccgcagagcctgcaagcctgcagaaagacagggagtagccacgtctttctgtagttcacacctgtgtgtctccccacctgataatccctcagcacttctgtttgccttgcatgtaaagcccgacctttgcatggcaggcacacagactgaaactctttcctcctccagcctttcttggactcatccacagaatgacaaagaagtattctgtgaatattggttgaatgaaggaaggcacggctttt

SEQ ID NO: 27256 - DNA, 463 bp, Homo sapiens
  misc_feature 29: n = A,T,C or G
gattcctgagctgacagcattcgggccgngtatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgcttttt

SEQ ID NO: 27257 - DNA, 249 bp, Homo sapiens
  misc_feature 7, 8, 33, 34, 36: n = A,T,C or G
cagaaanncagtccaccctgcacctggtgctcnntncttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctg

SEQ ID NO: 27258 - DNA, 213 bp, Homo sapiens
  misc_feature 6, 20, 30, 57: n = A,T,C or G
agtcanggaaacttccaagnacacttcccntataatagacattttcaagtaactggntgtgcaaaaggcagtaccgtgtgagtctgctatgtattttcactttgtagagataatgtgttcttatcatgatgctaccctcccacacatggatccctgaaccaagacgggccaatcagagccctctctcttggacctgggaattgtgacagaaag

SEQ ID NO: 27259 - DNA, 384 bp, Homo sapiens
  misc_feature 29, 30: n = A,T,C or G
agccgagccggactggtcaggatgatcanngacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatat

SEQ ID NO: 27260 - DNA, 188 bp, Homo sapiens
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtggt

SEQ ID NO: 27261 - DNA, 465 bp, Homo sapiens
  misc_feature 3, 28: n = A,T,C or G
aanaaacgcggaaccatggccgctgtgnttgctgtttgcggtggtctagggaggaagaagttgacacacttggtaacggctgctgtcagccttacacatcccgggactcacacggtgctttggagaagaggttgttcacaacaggtatccagcaatgaggacctgcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtaagtggttgtatgatgccaatactgactcaaaccaacctttggatagaaaagtgtttgaggagtgag

SEQ ID NO: 27262 - DNA, 490 bp, Homo sapiens
tcacctcttgtgttatcaaatactgggtcattttttctatttttttgtacccgtggaaagatcatttattgccctttattagcagctcatctttatcacttatattcccacagctgtggatacattcgtaataacaattattagtgatgacatctccacatgattttccttttaaattatatgcacctgtgttgttgtatttttttctgtgtcgtgtctgatgtctttctgcaggacttaattttgttatttggtttcctctctttctacttagcagtaagtctcaaaaaaataggttcatcttattctcatattatatactttagccaaaaatctatagtttaaaaataggtactgaatttatcacagaagtataatttaactacatagcaagaaatttagaaataaaaggaaagagaacaagatcatctatccagcttcctcagggaaaaggagctgatctatgtttaatcccttctgtgtttccaga

SEQ ID NO: 27263 - DNA, 105 bp, Homo sapiens
gaaaggttctgccattacaggaaccagtagctaaggagtgtgcagacttgtggccccggattgcatccaatgctggcagcattgcgtgattctccagtatatttg

SEQ ID NO: 27264 - DNA, 238 bp, Homo sapiens
  misc_feature 6, 7, 31: n = A,T,C or G
catcanntgaacatcctgtgtctccccagcntcctcagtggttgaaacactttgtccctccctcccccatctcatttttcatgtgaggttccatgtgacgatcccataacatggtaataggcagcgatggtcttgactttctgcttctattaacagctttcatttctatttctgctttcatgtggatggataaatctgctttatgtcttaacatttcagagtgaaatgccacacaatt

SEQ ID NO: 27265 - DNA, 490 bp, Homo sapiens
attcaccaaatatttatgatgtatttactcttctccaggtcccatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtaggtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgt

SEQ ID NO: 27266 - DNA, 120 bp, Homo sapiens
  misc_feature 30: n = A,T,C or G
gtacgagcaccaatgagcttactacccaanttcaaaactaggactctaacaataacttctgtcatatctcatcctgtaacgcccccaccttcgctccttccgccaagataattatcactg

SEQ ID NO: 27267 - DNA, 257 bp, Homo sapiens
  misc_feature 4, 28, 30, 73, 180, 187, 249: n = A,T,C or G
ccgncggcattcgtattgcgccgctagntntgaaattcttggaccggcgcaaggacggaccagagcgaaagcntttgccaagaaatgttttcattaatcaagaacgaaagtcggaggttcgaagacgatcagataccgtcgtagttccgaccataaacgatgccgaccggcgatgcgggnggggttnttcccatgacccgccgggcagctttccgggaaaccaaagtctttgggttccgggggggagtnttggttgc

SEQ ID NO: 27268 - DNA, 445 bp, Homo sapiens
  misc_feature 8: n = A,T,C or G
gaatatcntatttgtaatagcagttatcagttatgcttatatagcattaaaaattctcctcctttgactacacacacaaccacagtgtggttctaatcatggagatatcagtaatttttagtaactgaattttgaggacatttctctgtttagcatgtatgcaaactgatatgtaatccgaggttccaaagtcaatttttttctttttttttgagatggagtcttactctgtcacccaggctggagtgcagtagcacgatcttggcttactgcaacctctacctcctaggttcaagcaattgtcctgtctcagcctcccgagtactgggactactgtcttgcgccaccatgcctggccaacatggtgaaaccccgtctctactaaaaatacaaaaattggccgggtgtggtggtgggtgccttgtggtcccagctactcgggagg

SEQ ID NO: 27269 - DNA, 257 bp, Homo sapiens
  misc_feature 7, 254, 255, 257: n = A,T,C or G
ataatangtgaatattaaggataagaggaattagacaagaaagagccctattaagatggggaagatggaagaaggttgtgacagtctcagtcagacatcttagaggaaacaggagcctgtcccttctcctccatgtccatactagcctgctgaatcctttacttacaggatcagctgaatatgtctagttgactcaagggtctttttctgcctccctctgttacagctgtgttacctttttacatagcaaagcnnan

SEQ ID NO: 27270 - DNA, 441 bp, Homo sapiens
  misc_feature 25, 26: n = A,T,C or G
gttaatgtatgtgctccaaaacctnntcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaaaaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttg

SEQ ID NO: 27271 - DNA, 490 bp, Homo sapiens
  misc_feature 2, 5, 27, 58: n = A,T,C or G
gngcnccacagcagctgttcaacaagnagtttttattgtcacaacactgaacctctgnctagaggacatattcacagtgaacataactgtaacatatatgaaaggcttctgggacttgaaatcaaatgtttgggaatggtgcccttggaggcaaccctcccattttagatgtttaaaggaccctatacgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagac

SEQ ID NO: 27272 - DNA, 470 bp, Homo sapiens
  misc_feature 27, 460: n = A,T,C or G
atccgggatatatagttccttttgggnttgttgacttttcgaggccagataaagattttcaatatgtacctccaaatacaggtttgccacccaagaagggtagtaataaacttatgagtcatttattcctgctggagagaatagatgagatttctagcaattcgctcacttttcatagtaattaccatgcttgatctatgcaatagctagtgttgtgcatacgctgaggttaccttaaatttactagtcttatatgtactaaattaaatgcttgcatatgccccttacaagcaagattgtttagcaacccaattatgctttttcttatacctatactgttatggctaattatgtattgtattacatatgtctttttgaattaatcaaatgtatatgcacttggatgtttcctcttagggaactgaccacagtgataagttaggaaaaatagagatacttnaaattagaag

SEQ ID NO: 27273 - DNA, 270 bp, Homo sapiens
  misc_feature 5, 30: n = A,T,C or G
agccnctcttttgtttctttacttctttantaaacttgctttcactttactctatggactcgccctgaagtcctccttgcatgaggtccaagaaccctctcttggggtctggattgggacccctttcaagtaacatgatgaggtatctaaattaatgcatgattgaatgaaatcggaaaacacattatccaaggaagtcaatcctgaagccccatcatttcagaattaagatgaaacttacttccttttcaattgcctaaagaacagcta

SEQ ID NO: 27274 - DNA, 205 bp, Homo sapiens
  misc_feature 18: n = A,T,C or G
tatggcccgggcaggccnttgcattttgtatatgggaagattatgacaatcctaggtaattaaaccctagacccaaagcccttacgtttgatgcaatttatttttaaaataggccttgtttttcagcttcatctgcagttctatgtgaagattgataaatcagtttttacttgttttattaataaaacgtaatttggatatcttg

SEQ ID NO: 27275 - DNA, 500 bp, Homo sapiens
tatggcccggggattacttcagccccgggagttcgagactactgtgaactggcactccagactgggtgacagagtgagaccctgtcccccacacccaaagaaaaaaaggaagaaagtaggaacaaaagaagcataagaaaataaaaacaatatgaaaataaatgggaatttatcaatagtcttggtaaatgtaaactgatacctatgtttaaaagagattatcacattggattgtaaaaatctaactttatgttacttgtaagagctatgcctaaaatcaaaccacaaggtaagactgaaaatattagccagttatagtggtgtgtgcctgtggtcccggctacttgagaggctgagatgggagaattacttcaacccaaaaggttgaagttgcagtgaaccatgatcatgccactgcactccagtctaggtgatagagtgagactctgtcttaaaagaagcctgggcgcggtggctcatgcctataatcccagcacttt

SEQ ID NO: 27276 - DNA, 489 bp, Homo sapiens
  misc_feature 4, 169: n = A,T,C or G
aagncccaaggaaagaagaaaaagggcctttgccaaaatgaaactgatggtacttgttttcaccattgggctaactttgctgctaggagttcaagccatgcctgcaaatcgcctctcttgctacagaaagataccaaaagatcacaactgtcacaaccttccggaaggngtagcttgacctgacacagattgatgtcaatgtccaggatcatttctgggatgggaagggatgtgagatgatctgttactgcgacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagt

SEQ ID NO: 27277 - DNA, 256 bp, Homo sapiens
  misc_feature 22, 27, 32: n = A,T,C or G
attgatgaagacactgtgaagnacagnaggcntaaatgaatggaatggaattgagagacaaggaaaaaactcttacgtttatagccagtggaggtgccaggaaaatttaagagaagaaaggagagtcttttcaacaaattgtgctgggaaaagtggatattctcttgcaaaagaatgaagttgtacatctctttcacaccatacacaaaaattaactaaaatgaactatagacctaaatgtaagagctaaaactat

SEQ ID NO: 27278 - DNA, 491 bp, Homo sapiens
  misc_feature 2, 31: n = A,T,C or G
anagcccccctggtccaacgggaaaaacctnttaaaagggtatggcttattttcattgtgcattttgaaggcatctgccatgatcattagttttatttatttatttatttatttatttattttacttccttgctagtaataaaagtcacttcgcttaatcatgctgttggcattattagggtcgtccaggtgcagatggaggaagaggaatgccaggagaacctggggcaaaggtcaggagctcacatatttttatattcacatcctgtgtcagttcactctggaaaattttatatttaaaaatccattttctgaatctgagagaatatttcgcatttaaattgcagtacatatctagactggaattgtgatgatgatgatgatgatgatgatgatggttttacggggagatcgagggtttgatggacttccgggtctgccaggtgacaaaaggtcacagggtaagatacatctattcctttttttccagg

SEQ ID NO: 27279 - DNA, 488 bp, Homo sapiens
  misc_feature 5, 30, 31: n = A,T,C or G
aaaanaaaagaaatcaagtggattggcctnnctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatggggatgtcgtttggcctggagtcaggcaaatgctctctggaggatctgaaacttgcgaaatccctggtgccaaaggctttagaaggttatatcacagatatctccacaggaccttcttggttaaatcaggg

SEQ ID NO: 27280 - DNA, 255 bp, Homo sapiens
  misc_feature 30: n = A,T,C or G
actttctcctatggatcacatgatgaaatnacaatatttgggatgtatttggttaaatcaaatagattaatcaatttctttttacttttttaaaaaacacagctactagaaaatttgaagttgtacatgtgtcttgaatgaggatgaaggaaatggacctgggtcagagttgagccagagaaaagcccggaacacagttttttttccattttaaattgtgattttctcaattcctggcctcagtctcctgagagg

SEQ ID NO: 27281 - DNA, 490 bp, Homo sapiens
  misc_feature 454: n = A,T,C or G
acctgccaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgnccgcaatgttgccagtgtctgtctgcagattggcta

SEQ ID NO: 27282 - DNA, 369 bp, Homo sapiens
atgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttga

SEQ ID NO: 27283 - DNA, 173 bp, Homo sapiens
  misc_feature 7: n = A,T,C or G
tcggccnttatggcccgggatagtgacctaaaacctcagtgactgtagactcagggcaaccctagacttaaaagtcccatgtggtcttttacatgtaaaaaatgagaattagtctaaaagtcaattttgtctaaattttgatttttggtgagtatacagtcaaaatagttgtg

SEQ ID NO: 27284 - DNA, 406 bp, Homo sapiens
  misc_feature 13: n = A,T,C or G
aacttattaattntacattcgccgcacataattgaatacttcttatgtgtcagaaactgttctaggtgcttgggatgttcattgaacaaaatagacaaaagtctccgcctctatggaacttactttccagtgaaggtgtggattggtgggatagaaaataaaataatcaagtaagatatgtacttaggctttcataaaaatacagcagggcaagaggaccaagatggaggcagtgatcagggaatctcaatgagggtgagactgcgacaaagacttgaaaaaggtggagaagcaagccttgtgggtatttagggtagcagtagtccaggcaaggggaacaactagtgcaaaggctctaggaggcaatgtgtttgaagtgttttaagaacagtaaggaggctagtat

SEQ ID NO: 27285 - DNA, 345 bp, Homo sapiens
  misc_feature 17, 25: n = A,T,C or G
gggaactacagtttatnagaagatnaacttttgctaattcaaataccaaaggcctgattatcataaattcatataggaatgcataggtcatctgatcaaataatattagccgtcttctgctacatcaatgcagcaaaaactcctaacaactgtggataattggaaatctgagtttcagctttcttagaaataactactcttgacatattccaaaatatttaaaataggacaggaaaatcggtgaggatgttgtgctcagaaatgtcactgtcatgaaaaataggtaaatttgttttttcaactactgggaaactgtacctcctagaaccttaggttttttttttt

SEQ ID NO: 27286 - DNA, 319 bp, Homo sapiens
  misc_feature 2, 6, 35: n = A,T,C or G
cnggcnccggtgggctccgtgcccttgtaatcccngcacttttgggaggctcaggtgatccatcccccctcggcctcccaaagtgctgggatgacaggtatgagccaccgcacccggcctcccaggacttttcattggcgagccagtgaatcccttacggcgaagcctgtttacactcaactttctgttatgacgattgacagcttccttacctgcccagagaaaagcgaacaaatggtgacctcagaagcagcatatagaactcagggaacagagacctttaaaaacctagagagactgtgaagatatgacgcaatag

SEQ ID NO: 27287 - DNA, 179 bp, Homo sapiens
gggaggcgggaggaaaagaagaagtataatagtataaaagtggaggaaagagaagttacaagatggaggaaaatgaaaataaaatgtattacaggctctgctatcctgaggcaaaactgatttatattttttgtttctttgtgggctttgttagaaggacttgcatatgctacaaaagc

SEQ ID NO: 27288 - DNA, 252 bp, Homo sapiens
gtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttc

SEQ ID NO: 27289 - DNA, 235 bp, Homo sapiens
tgagcaggagtgagaagcaatttcaaatgaaaacatcgtttatcatctgctgaaagaaaccaaaaagaacacaggaaaacaaaaagacaaggaaagggaatgaaaatgtaattcattttattaaaaagaagaattattcttctgggacactggatagaaaccttaatgagttacctagctatcataaatcctctaacagagaagagaagagaaagaaacaaagacggaagagggc

SEQ ID NO: 27290 - DNA, 118 bp, Homo sapiens
  misc_feature 79: n = A,T,C or G
tgctgacggagagcaggacaattacaatctgtctgcatagtgcccaccccaccccctcgacaagaggggctgccatttnctgcgcttagctagggaaccgtaaccttcatgccggctg

SEQ ID NO: 27291 - DNA, 481 bp, Homo sapiens
  misc_feature 1, 14, 39: n = A,T,C or G
naagtggggcaagnactgttatcgagtaccggtcacagnaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaact

SEQ ID NO: 27292 - DNA, 222 bp, Homo sapiens
  misc_feature 34, 37, 43, 47, 56, 80, 94, 104, 127, 129, 177, 198, 206,214: n = A,T,C or G
ctttttggttgatacaatgattctattaatctanatnatcttnggtncttatgggnagcccataagcgtaaataaggggnccattaaattgggnaagggagagnccaccaccaccttttggttaaangnttccaaggaaagtgggggtttccctttttaccccaggggggggggggnaggaccagggaaaaaaaaaantggggggngagtttcncccccccc

SEQ ID NO: 27293 - DNA, 130 bp, Homo sapiens
  misc_feature 6: n = A,T,C or G
agaaanatgtagaggtaatggataaattcctggaaacacacaacctcccaagtactgaatcaggaagaagttgaaactctgaacagaccaatagcaagttctgaaatcgaatcagtcataaaagcatact

SEQ ID NO: 27294 - DNA, 457 bp, Homo sapiens
cagcggctacatctgcaggaaggacgaggccaaaacgggctccacctacatcttttttacagagaaaggagaactctttgtaccttctcccagctacttcgatgttgtctacttgaacccggacagacaggctgtggttccttgtcgggtgaccgtgctgtcggccaaagtcacgctccacagggaattcccagccaaggagatcccagccaatggaacggacattgtttatgacatgaagcggggctttgtgtatctgcaacctcattccgagcaccagggtgtggtttactgcagggcggaggccgggggcagatctcagatctccgtcaagtaccagctgctctacgtggcggttcccagtggccctccctcaacaaccatcttggcttcttcaaacaaagtgaaaagtggggacgacatcagtgtgctctgcactgtcctgggggagcccgat

SEQ ID NO: 27295 - DNA, 311 bp, Homo sapiens
  misc_feature 195, 211, 266, 276: n = A,T,C or G
atgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacactttttttttnggtttattccccagtnttaaaaacaaagcaagctgagtctgaacaaatggatttttctgccatcatttgtncaatgctganctgtctggattgaaataaaatgaccatttttatgc

SEQ ID NO: 27296 - DNA, 172 bp, Homo sapiens
  misc_feature 11: n = A,T,C or G
agctaaagagnaccaccccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtcc

SEQ ID NO: 27297 - DNA, 418 bp, Homo sapiens
  misc_feature 4, 5, 14, 273: n = A,T,C or G
ggcnngcaaagaanaaccggaggctgaagcaggccaaataagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcntaaatggatagaagagagaagcacctgtgctgtggagtggcattttagatgccctcacgaatatgaagcttagcacagctctagttacattcttatgatatggcattaaattatttccatatattatataataggtccttccact

SEQ ID NO: 27298 - DNA, 339 bp, Homo sapiens
  misc_feature 12, 19, 137: n = A,T,C or G
gtacccgggaanttcggcntttatggcccggggtcactgaggaagagtagatttcaagaccttcgctagtctccgtatggcccgtgccaacgcccggctcttcggcatacgggcaaaaagagccaaggaagccgcanaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgt

SEQ ID NO: 27299 - DNA, 145 bp, Homo sapiens
  misc_feature 4, 13, 22, 37, 52, 93, 131: n = A,T,C or G
ctcngagaattgnaatgttcgntttctcctgcctgtnctgagactcgaagtnacactcaagggaacttgagcgtgaatctgtatcttgccggncatctttatgttattacagggcattcaaatgggctgcngcttagcttgcacc

SEQ ID NO: 27300 - DNA, 149 bp, Homo sapiens
agggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttt

SEQ ID NO: 27301 - DNA, 139 bp, Homo sapiens
ggcctgagaagatgagaggaatatttaaataacatcaacagaacaacttcactttgggccaaacatttgaaaaactttttataaaaaattgtttgatatttcttaatgtctgctctgagccttaaaacacagattgaag

SEQ ID NO: 27302 - DNA, 431 bp, Homo sapiens
  misc_feature 3, 10, 38, 42, 49: n = A,T,C or G
aantcggccnttattggcccggggcctgtttctgagangccnttattcnagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatattgtaagacttggctcatagaaacctaatcaga

SEQ ID NO: 27303 - DNA, 418 bp, Homo sapiens
  misc_feature 290, 294, 354, 355, 362: n = A,T,C or G
attgtttagggaccttaaaggatatgaaggaattgagctgagtttttttttaagaaaattttttctctcaactctaggaaaggaaagttcattgtggtatcatgccagttacaacgttacttacacaagttttaagtgatattagcgatatcagcgatcttagtaatttttaaagtaggttgtttcctgttctataaatacatagaaaattattggtttttacaacctcttttctgataaaagaatgactgaactatcatttcactgctatgtaattaaatttgggtgcngagnacttataataattctagtcaatttcacacacctaatgttactaccacctaaaaagaattnnctctcangctgctttgccagctacatcttcattcttgtatctaaaaaaacctaattataatat

SEQ ID NO: 27304 - DNA, 112 bp, Homo sapiens
  misc_feature 11, 20: n = A,T,C or G
tggcccgggancttgttgantgaaatgaaatgaccttcatttttatgtgtataaatttggtgactactgaatttataacaaccctgatggaaaacaagtctgacatgtttgg

SEQ ID NO: 27305 - DNA, 476 bp, Homo sapiens
aacgtctttgttgtttatggaaaagcccagatactggatatatcactatgtattttatgaacagaattgactgggactaatatcacaggatcaatcatctcagaatcttacttgatgcattatttattttgctttagatcttgaatacattttgagaataactaatgtggattgaaatgtagagatacactggagtgctttatttagcaatatttgatgaaagcatgctttctacgccattcaggaaggcagcacaaatttatctcagaaaggttcctgtgtattgcaaggtacaattttctccaataaatcaggagaacaggagtttgatgatgcaaagttgatctctgtacatttaagtgaaaagtctttataacttttcacccttaaaatatttcagcagacatgtctgcacatgacagtgtaaaaaagtttaatgtcaaatgcaaagtttttattcattccaagccaccact

SEQ ID NO: 27306 - DNA, 465 bp, Homo sapiens
ggagcatttaagaagcatcctctgccagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagagtcttcatgtattctggagaacaccattcctgatttcccacaaactgcactacatcagtataactgcatttctagtttctatatagtgcaatagacattaga

SEQ ID NO: 27307 - DNA, 286 bp, Homo sapiens
  misc_feature 6, 9, 222, 266, 274: n = A,T,C or G
aagaangantaaatatatctttgtaaattattttatgtcatagtttaattggtctaccaagtaagacatctcaaatacagtagtataatgtatgaattttgtaagtataagaaattttattagacattcccttactttttgtaaatgctgtaaatatttcataaattaacaaagtgtcactccattaaaaagaaagctaatactaatagcctaaagatttgntgaaatttcatgaaaccttttaatggccattatgactaagaccngctggatnaagggtttaccg

SEQ ID NO: 27308 - DNA, 422 bp, Homo sapiens
agtcagctcccactgcagtattctagggcattcgcagaatgactagtagtgctctaggctcccaaatgttccagacatcctatctcaactcctgcacttctgcctttcatagagcccccagaaaagatgtgtttagagccatgtagattctgttgagagtctagtaaaaccactctgctcagtggctttctagatgctccacctaccccaaacataccactgtactctccccccagtgagacaggaagaatcctcttgagccaatgccttttagcccctgaaaagaaactaatagaggaatcaacctcaaggggaaatcattatggaagagcacatctgtgaaggcagtagctagatctgctgggagtctgaggaatctgctcctagcacccccttgtaataggaggacccagagcatccct

SEQ ID NO: 27309 - DNA, 469 bp, Homo sapiens
  misc_feature 20, 21: n = A,T,C or G
gagacggagaccctcaaaannaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctcca

SEQ ID NO: 27310 - DNA, 230 bp, Homo sapiens
attaacaatcgtgtgatagctccctgggttttcaaaaaacaacttatttgtttcagtatatgtttaatttggcacaaaatctttctacagtcctatatttttaaggtttcatcttaatgcatttccatcctgctggaaaaaaaaattaaatgtaatcagacattttgtatacagtgatgaagtggttaacatctgctttgaagatgatactttaattaataaagcatcat

SEQ ID NO: 27311 - DNA, 111 bp, Homo sapiens
aagcctacttgggaggctgaggcagaagaatcgcttgaacccaggaggcagaggttgcagtgagatcatgccactgcattccagcctgggaaacagagcaagactccatcg

SEQ ID NO: 27312 - DNA, 471 bp, Homo sapiens
  misc_feature 16: n = A,T,C or G
gttgacagggcagagnagagcaattggaggaactagcccatctattcttggtgctgttttttagagcttaaaacttgctgggtgatgtcaaagcatttacgccccaaagatgagaaccactgctctaatcttgaacgtttccagtgatgaaaggcttgctcacaatcatttggaaatagcccattacactttgggattcctttgacaattcctctgtatacctagcagagtgactcattatggtcactagttcctagttctcatctttaagcaaatacagaacaaatttgttcctcctctatctgatggtctttaaaatatctggagccatcttaatattcctactgattattcttgcatacatagattgggtcatgccacaatttcttatattccatattttgaaaacctctcatgatcatggctctccttctctgtattttctgtgtgtagaaataaacaccatcatct

SEQ ID NO: 27313 - DNA, 321 bp, Homo sapiens
gatgtcaatgtccggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatcta

SEQ ID NO: 27314 - DNA, 196 bp, Homo sapiens
ggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttct

SEQ ID NO: 27315 - DNA, 469 bp, Homo sapiens
gtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatgg

SEQ ID NO: 27316 - DNA, 460 bp, Homo sapiens
agagatattagtagagggaaggcttactactactaccttcctgttcaataagagttggtatcaaattcttttattatacattttctgttagtggagatggcaaattcatgaagtttggtacaatgagtttatcttgagccataatcctgtcttgaatacataaaaatctatataaatttatgtgcatatattcaatttttgtaattcaagataacagagcttatcatttctaggcacaaggcttagcattttggtagcatagatataaatattctctaggaatagtgaatggtgagtaaagttaaaatgggaattagaaagatttccagggtattatcacccataaagatatattaaaataaagaaaatgaaattcaatatgtacatcagaatttcagatctagagcctacatctctgcattattttttatgcaaaagatttgtgatctattaaatctat

SEQ ID NO: 27317 - DNA, 270 bp, Homo sapiens
gacactgtgctttgaaattattgtaacatctcagtaaatatataggcctatgtcttttaccctctatatgtaataatcctgataaatgaatacagtgatataagactgtgaaggcggtaagtcagctggtcacatacatattgaaagaaaaacccttgggtacagtggctcatacctgtagtcccagctatttgggaggctaagatggaaggatcatttgaggaatttgagtccagcctgggcaatgtggtgagaccctgtctgtaaaag

SEQ ID NO: 27318 - DNA, 425 bp, Homo sapiens
  misc_feature 6, 15: n = A,T,C or G
gggccntttctgatnttactattaaattctatacccatttcttttatacccatgttctcctctttgcagaattcctaagaaggagaaaaaatcactactcaccttttcaatgatttacatcacagcttctagtgatttttggcagaaaaataaccctcagattttcttttggacggtaccataaagaaatccaaatagccattctttttattaacccaattcttgtaaactttaaattattactctaagtttcgagattaaaaagaccaccaatctttggaactgaagaggctgattgagttacaacccaggaaagaaatgaactcttttcatccctatctgtgtggatcataagaataatgccagaacgcttggaaagagtctcagaataataaaataataatgacagcattacttatattaat

SEQ ID NO: 27319 - DNA, 460 bp, Homo sapiens
atagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgttcaagctcaacacccactacctaaaaaatccct

SEQ ID NO: 27320 - DNA, 211 bp, Homo sapiens
gtgagtggggcatctgttggactttcacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagc

SEQ ID NO: 27321 - DNA, 472 bp, Homo sapiens
  misc_feature 14: n = A,T,C or G
ggacgcgcccggangaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttca

SEQ ID NO: 27322 - DNA, 354 bp, Homo sapiens
ggttcatggctctctgtaaaactgtcctatgaatttcacccttcctccaacctactcctttgttcctctcctcattttctattttgcttttccttgagtggtggagccgaatgctctgaagtaattttggaacacagtgagcctactgagccaccggacagccggctgataccacgtgcttgggaacaggaaaggggacccagctataaactcctcagcagccatgccatgccctatcaccgtcatccttccccaacaccttctgaccttgataaacacagtcaggaccaagaatgtgctcatatttacatataccactccctcccataaaaatagggtaacctttaaaatcac

SEQ ID NO: 27323 - DNA, 229 bp, Homo sapiens
  misc_feature 121: n = A,T,C or G
attccataaaacctattatgattgccttcatttatggcatatgatgttggttttccacttaaataaggtttgtttgtttgtttgtttgttttttgagacagagtcttgtcctgttgtccangctagagtgcagtggcatgatcttggctcactgcaacttctgcttcataggttcaagcgattcttgtgcctcagcctcttgagtagctgggactacaggcacgcacca

SEQ ID NO: 27324 - DNA, 379 bp, Homo sapiens
gagagcggagtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacggaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaacccca

SEQ ID NO: 27325 - DNA, 415 bp, Homo sapiens
ggcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgggagatgaagaatttggattctctcatcaaggct

SEQ ID NO: 27326 - DNA, 455 bp, Homo sapiens
cagctttctctgtctgaatccgtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagatagggttttgtcagagcataatcattgtctgcaaagtgtttggtgcgaggaagattattgctaattttgtgaaataaaga

SEQ ID NO: 27327 - DNA, 359 bp, Homo sapiens
gaagacagcttcaaatctgcagatgaatctggacaggcactgcttgctgctggtcactatgcctcagatgaagtgagggagaaggtaagagaagagaaatggagcttttgaggagcaaattacacctttcactaagtctctgaaagctattattcatccttaaatatccagagaacgcattcaccatgatatgtgagaaactttcctttctctgcagaggtttaaaaagaaggtatatgtatagtgtgctgatttcctgagagacagtcctccttatctggggcatgtgtggcatgtttcctacttacagggactttctgtagggagctgagtcttgcattaggaagttggagcaaaga

SEQ ID NO: 27328 - DNA, 471 bp, Homo sapiens
gttgtttccataccacttcagcttattccttcccgtggagggagtttaatttgtataacactcctggcttttgactcactccatccaggagaagtgaagtgacttagtggatttttgtaaatttagtgagaattagctgcacaaacccagaatggcccgacctctttttttctcttgggaatgagctgcccaccagagccaggacgacggtgcactgagggagatactcgctggaggcactaaggcaacaggattaacagtaccctacccagcctggagccccaggcaaagggaaacacaagtaactgtggctggctggttatctaactcatctcctcttctttctagcacacagatattatgtttctatgtgttttgcaggtaatgctgtgtgttccagacagcagaatgtgagtggacatcatatgtaccacctctgggcctggaccatagaactcacacataatcctt

SEQ ID NO: 27329 - DNA, 377 bp, Homo sapiens
  misc_feature 2, 211: n = A,T,C or G
cnttatggccggggaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagnggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttatttt

SEQ ID NO: 27330 - DNA, 481 bp, Homo sapiens
atggccggggcccagcctacttacttattcttgatgaaggatgaagggctgagaatctgggctaagggccttagctaagaggcagagaaacctgcagagtctctagcagtctcagagggctgaaaagacaaaagttgctgttctgtctaccaaagtaactaggacttttagatccaagatttgggagaaaagccataaagaagtgagtagctctggggatggtggctcatggctgtgatcccagggctttgggaggctgaggcgggaggatcgcttggggccagaagtttgagacgagcctggccaacatggtgaagtcccatttctactaaaaatataaaaattggccaggcatgatggcacatgtctgtgatcccagctactccggaggctgaggcgggagaatcgcttgagcctgggaggcggaagttgcagtgagcccgagatcgcaccactgcactccagcctgggtggcagagtg

SEQ ID NO: 27331 - DNA, 349 bp, Homo sapiens
  misc_feature 302, 307, 327, 347: n = A,T,C or G
ctatttgaagtgtaattgagaaggaaaattttagcgtgctcactgacctgcctgtagtcccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtggatttgcctgtaacaagccagattttttaaaatttatattgtaaatattgtgtgtgtgtgtgtgtgtgtatatatatatatatgnacagntatctaagttaatttaaagntgtgtgcgcctttttatttntg

SEQ ID NO: 27332 - DNA, 457 bp, Homo sapiens
gaagtaaccctcaactttactcatatctgacatcccattacaacgttctttgctcagcagaacttccagccctgatcctgctatactgtgctctcttgtccttactggtaaacctatttctaacccttcactgacatctttgcttgcaagtcctgacacttgactaaggagcgctgccatagcagacaggcggggctggggcttgtcccatatcaagtgcttcctgctgggagcagtggctcatgcctgtaatctcaacactttgggaggccaagatgggagaatcacttgtgcccaggagtttgagactaacctgggcaacatagcaagactccatctctacgaaaaatagaaaaaaaatagccaggtgtggtggcatgttcctgtagtcctagctactcaggaggctgaggtgggaggatcaagttcaggaggccgaggtggcagtgagccgtga

SEQ ID NO: 27333 - DNA, 206 bp, Homo sapiens
gggttcaagcaatcctcttgcccccagcctcctgagtagctgggattacaggtgtgcaccaccacgcccagctaatttttgtatttttagtagagacggggtttcatcacctgaggccaggagttcaagaccagcctggccaacccatggtggaagttgcagtgagccaagatcatgccactgcactctagcctgggtgacagagc

SEQ ID NO: 27334 - DNA, 461 bp, Homo sapiens
  misc_feature 448: n = A,T,C or G
ggcagcgcgcggcgtcagtcttggctggcagacctgtactccgtactccgtacttcgtagtcgcagcggcgcggtcttcggcagtttagtcatccaccgccatcctgggccccacgtgttgcctgaccattcctgagcccaggtgggagccgtggctgaggtgacggtctcaaagtggaagagcttactgtcacagcaactcctttgcaagatgccccggccaggaatagttgctgaacaccccaggcctgctgaggtccctccttgagtctcatgttcaagcagtctttgtccatgaaactgggaggcgaccgtgttagctgccagttcctgacagccacctctcaccagtggcttcactctgtgtccctgacccagcacatggcacaagagtgcctgccatccgtcagtgtttctacagcagcaatccctagatgctggagctagnaggggacctgacc

SEQ ID NO: 27335 - DNA, 242 bp, Homo sapiens
agggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatgtatatatacacacatgtgagtctggctgggctggtattttgtttgatcttcctggaaatgagcagtgactaacgc

SEQ ID NO: 27336 - DNA, 392 bp, Homo sapiens
  misc_feature 9: n = A,T,C or G
gaggcgagnagctgcgaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggctattaagagatgcaagcattttgaactgggaggagattaagaaga

SEQ ID NO: 27337 - DNA, 166 bp, Homo sapiens
gagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggc

SEQ ID NO: 27338 - DNA, 233 bp, Homo sapiens
gagttcacacaaaattttaggcagtgtttcaagaaacactcttatgtgttgttctttcagcccatgctccaggtcaccggtttttaggtaaacatgacatgacatgtacttgtaatatcagtgaaaggggcttttagtcgtctcagtatcttttttgcattcaggtattatagcgtttccaacaaattgagaaattacttatttggtgtaaaatgacaagagagagctttaga

SEQ ID NO: 27339 - DNA, 465 bp, Homo sapiens
gtaaatgatgaactttaaaaatgtgtccaggtgttagatgagttcattagactcttttaatgctaatggctagtacgtttaaacaaaacagcagttctctgctgcaatattcccattgaccacttaaatgaccataagtggtcatttaagaacatgttagggttagccctgatctgaatataaaagtgagaaaagggctacagtgcatttcttggtaacttaaactgagtcttgaagttataatgatccattcgagttctgtgatccttattgttcttaattgtgtttctctacgtattgttacagatgagccatacgtttctttgtatcaatgtagacatgacttcagatacctctgaggacctacccagcagtctaggaccctgggccaagtgctgggactatggtactaaatccagtagatgggctgtgtagcaactctcccagggaacacactagggtact

SEQ ID NO: 27340 - DNA, 284 bp, Homo sapiens
  misc_feature 5: n = A,T,C or G
aggtnagaagtagaatcttttctcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaatc

SEQ ID NO: 27341 - DNA, 386 bp, Homo sapiens
acgcattaatagtcccatttttctcttgcctttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatataga

SEQ ID NO: 27342 - DNA, 467 bp, Homo sapiens
gaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggca

SEQ ID NO: 27343 - DNA, 461 bp, Homo sapiens
ggcacagcctgcggcgcagcggaagcggaccgcagtcgagtctgcagagtgttggaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgca

SEQ ID NO: 27344 - DNA, 273 bp, Homo sapiens
  misc_feature 23: n = A,T,C or G
gtagattaaaaatctttgttttntccacaatagaattgaattatatggctaggaacaccagcaagcacttcctgtcacagttatcgaaacagtcttttaaagaatgtctagagggccttacttaaacaaatagcttgtcttgactttgggaggaggatggttacctaagcccatgtgctaaaacagacagatgacacactgaaatgaccaacgagcataataaggagaattcagtatccttggaaaccctggaacggtgccataactaaacca

SEQ ID NO: 27345 - DNA, 153 bp, Homo sapiens
tgatatacttttttaactttggtgacttttctgtttgcctgtgatcattggattgttaatcatacttggttacagtcactggattggtttctatttgtctttcaagtagccaagtgatggataggaatcaacaatgttttctttcctgctcct

SEQ ID NO: 27346 - DNA, 431 bp, Homo sapiens
gttttttccatggaacaagcaaatacacatgttaattccatgtgaatatttgcagtttattggagaaagtgctttgaaagcaatatctctttgtacatagcaatgtacaaatatatttctttcaatgatactgaaagcctactttccaggtgtttagagttgcttgagtagtaacaaaatcgcatcccatcacacgctatcaaattgtaatttaaatgcttaccttgctttactaacaataaacttcatgttcctcaattccttgcaatttaaattaatagccaaatccagttgaagaaatatttactgaagaatatctaacgggagaggattatgattcccagaggaaaaattctgaggatacactatatgaaaacaaagaaatagacggcagggattctgatcttctggtagatgggagatttaggcga

SEQ ID NO: 27347 - DNA, 380 bp, Homo sapiens
gtgagatggcagggcttcatcctggtctggtgcctcattttcttctttagcagtgggcttagaaccaatgcagattcccaagttaagtattttttctgtagcttaattattacaggcttctggtgcctaagccctttcttactttctgttctgaggggaagagaagataatgttgtttctccgccccccccccggagtggccccaggaccttgcatggcatttgcagcatttgcagcgtgcttgggtttgctttactagggtgaaagtgttgcaccccccagcacccacaaaggcacctctgctcacactccggtgaggttctgactggccctgggacatcacctgctccaggatcctatgtggctcatcccaggagaga

SEQ ID NO: 27348 - DNA, 360 bp, Homo sapiens
atatgtaaaaaaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataattggttgacctgggtttctctgtatagtactggcatg

SEQ ID NO: 27349 - DNA, 280 bp, Homo sapiens
gggaggctgcggcggagccccggcggggcgtttggtttcggtttggccctgactgggattagtgttgacgatcgaaatgggagtccccaagttttacagatggatctcagagcggtatccctgtctcagcgaagtggtgaaagagcatcagattcctgaatttgacaacttgtacctggatatgaatggaattatacatcagtgctcccatcctaatgatgatgatgttcactttagaatttcagatgataaaatctttactgatatttttcactacctg

SEQ ID NO: 27350 - DNA, 316 bp, Homo sapiens
  misc_feature 37: n = A,T,C or G
gatgatgaagcatggttacattggcgaatttgaaatnttgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacga

SEQ ID NO: 27351 - DNA, 305 bp, Homo sapiens
  misc_feature 7, 21: n = A,T,C or G
ctccccngggaaattcggccnttatggcccgggggaaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgagtatcactggagtctgatggaaagggataggcgcatctctggagttgatcgttactatgtgtcaaagggtttggagaacattgattaaggaagcattttcctgattgatga

SEQ ID NO: 27352 - DNA, 242 bp, Homo sapiens
gatgcacaaaggcttttgataaaattatcacctcttcatgttaaaaaccctcaaccacctaggtactgaaggaacgtacctcagaaaaataagagttatctatgacaaatccacagccaacatcatactgaatgggcaaaagcttgaagcattccacttgaaaaccagcacaagacaaagacgccctttctcaccactcctattcaacatagtatttttaagtcctggccagagctatcagg

SEQ ID NO: 27353 - DNA, 291 bp, Homo sapiens
  misc_feature 3, 7, 33, 34, 43: n = A,T,C or G
ganaacnagcgcaatcctatgtctagaggtccnntattcaacnaatagggtttaccgacctcgatgttggatcaggacatccccgatggtgcagcccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccaccc

SEQ ID NO: 27354 - DNA, 118 bp, Homo sapiens
  misc_feature 5, 8: n = A,T,C or G
agganttntcttgacttcgtctgatggtaaaatatccagattatttgaaaatttataagaaatttctaaaacttgtgatattaatgtacccaggagaggaccatagaatcttttccct

SEQ ID NO: 27355 - DNA, 372 bp, Homo sapiens
  misc_feature 3, 25, 28, 39, 44, 65, 66, 71, 72, 73, 357: n = A,T,C or G
ctntgggccccggggggaaccccanccntgggaccggantacangacctttgaccaagttgagannacgannngcttcagaccgactcggtaattaaccaaaccttctctgagcctaaagggagggattgttccgaaccccatcgcaaataaagcctaaaaacccttgaaaaaagattagaccgaatggctgacctagaataaacagtgtagagaagtccttaaatgaccctgatggagctgaaaacccctggcaccgagaacctgtgtgacgcatacacaagcttcagtagctgatttgatcaagtggaagaaagggtatcagtgattgaagatcaaatgaatgaaatgaagtganaaggagaagtttaga

SEQ ID NO: 27356 - DNA, 416 bp, Homo sapiens
  misc_feature 5: n = A,T,C or G
aattnggaaaacttattacagcaggttaattcactttgttcaacatttgatctcagagttttagtccaccaagttgaggcatttctctcaaatggattgatttgagacttccaggaagaaatagtgtctggttagtagttcctaaaatggcttctgatgaatttccgctgaaggagcagtggagtacatgccagtacgaaggcaagtagaaagaagaaagataaagaaaacaggcctcacccattcgctttacctcttgaatttagaaaggatttgtttcctgcccttggacttctgttaggtgcctggacactaaggcctgaaggctcagtgacagttgctggtaatgtgcagaagataggccattgtgttagcagtttgcatgcaggaccctcatacagttgtgccctcacact

SEQ ID NO: 27357 - DNA, 423 bp, Homo sapiens
  misc_feature 7, 16: n = A,T,C or G
gaagccngctgaagangagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatac

SEQ ID NO: 27358 - DNA, 364 bp, Homo sapiens
  misc_feature 4, 14: n = A,T,C or G
gagnggggagaaanaaaccccttttcctttggtggggaggagcccttaaggctgtgttccgatcagccacgcacacatccgtgtcccctggccctaccctgggatgacagagccatcccttcacgttccaaggttgctcctgcctcaaatcccagattttccatgacccagcctggactcagtcccacttacaaccgcttggctccctctctcagcctggagaagcattctggaagcaaagctcctgctccgagcccagctcccttcaaattcattgtcctgatttcctaggtgccttttaaactttccttgtttttctattttcactcctttttttcaccccttcactcctctcttggacagc

SEQ ID NO: 27359 - DNA, 140 bp, Homo sapiens
  misc_feature 17, 24, 30, 42, 62, 89, 117: n = A,T,C or G
cggggggggtttttttntaagtantaaacnaaaagttttttntcagcccttcctgaaaagangggaaagtaaaatgtaccaagtttaantaaaaagggggcccttcccctttagaantaaatttcagccatgtgcctttc

SEQ ID NO: 27360 - DNA, 286 bp, Homo sapiens
  misc_feature 8, 21, 30, 38, 44: n = A,T,C or G
tgtagtancaccctggtaganggggttgancctgaaanggtccnaggtgggcttccccttatgtgtctgccccccttacgggagatgggtgggaagcctggctcatctggggctattaaccagaatactggcatttgtcctgtcctctggggtggatttgcccatcaaaacttgaagttctagcagggcagggtagatactcctactatagttccaactacctgggaggctgaggcaggaggatatcttttagttcagcccgagcaagctagcaagaccccatctc

SEQ ID NO: 27361 - DNA, 491 bp, Homo sapiens
  misc_feature 9, 10: n = A,T,C or G
aattcggcnnttatggcccgggcaaaccagggatgtggaagaatctccccacaactgccctgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggata

SEQ ID NO: 27362 - DNA, 390 bp, Homo sapiens
  misc_feature 1, 13: n = A,T,C or G
ngccggggggganctccgtcacattgtagtctaagtaaatagagccctcctcacactaacacaactagaccacaatttgatttaaaaactactttaagggccgctcacggcagctcacatttgtaatcccagcactttgtgaggccgaggcaggaggattgctggagctctggagtttaacatcaccgtggcagcatggcgagacccttgtctctactaaaaataaaaataaaaaaaattggccgggcatgatggtgcatgcctgtagttccaactactcagaaggctgaggtgagagtatcacttgagcctgggagtttgaggctatagtgactgatgatcaagccactgcactccttcctgggtgacagagcaagaccctgtcccaaa

SEQ ID NO: 27363 - DNA, 171 bp, Homo sapiens
atctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttg

SEQ ID NO: 27364 - DNA, 402 bp, Homo sapiens
gctctttcccttcggtgtgccctgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaaagttgtggcaaagatggcttccatatccgggtgcggctccaccccttccacgtcatccgcatcaacaagatgttgtcctgtgctggggctgacaggctccaaacaggcatgcgaggtgcctttgga

SEQ ID NO: 27365 - DNA, 237 bp, Homo sapiens
  misc_feature 4: n = A,T,C or G
accntcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccc

SEQ ID NO: 27366 - DNA, 442 bp, Homo sapiens
gaaaggaaattgatgcagcttgtaaaacattctccaaggactcagtggagaaattaaaagttttttcatctggtcctgatatacattatgacccacatcgctggttagcagaaagcaagactaaacttcagtggctctgtgaggaactgaaagagagagaaaacagagagaaaaatctgcgacaccagctgatgctctgcagacaacaactcaggaatttgactgaaaacaaggaatctgagttgcagtgtctctttcaacagatagaaaggcaggagcagcttctggatgaaatacatcgtgagaagagagatctcctggaagagacccaaagaaaagatgaagaaatgggatctctgcaggaccgtgtaattgcattagaaacggtaaagttggggcattttctttctccttttatcagaattactgctgtctcctgatg

SEQ ID NO: 27367 - DNA, 346 bp, Homo sapiens
ggcagccgtgcgatgttgtcctctacagtcatgtattcggctgctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatga

SEQ ID NO: 27368 - DNA, 236 bp, Homo sapiens
  misc_feature 3, 11, 37: n = A,T,C or G
acnatgaatcngctaaaatccctccctggctattccnatgaatgagggacagatttctttcctggagcataagtcctatagtaatatgcccctaaggaatagaatgtgatagaaatccttggaatacgatatctcatacttgataaccttgggacaaactgtggataattttcatataggtataggcagagcatcaggcacatggtttataagccaaaatgtttgataggaaactg

SEQ ID NO: 27369 - DNA, 343 bp, Homo sapiens
  misc_feature 30, 53: n = A,T,C or G
gagaccatgaaaattataatgattcatgtntatttgtatgatgcttgtaactntgccaagtcttttttattcattgtctcatttggtcagaacaattttattgaggacatgaatttaacaattagaatttagattttctgactgtagctactaaatgttgtagctactagaccaggtgagttaggtttagagcaaagtatataagccttgtatggactatattagaattttaaaaattgtaattaattccttatcatcattataaaaagcttgatttttttatttgatctaaaaaagcattattccaaagaattttttcaagtagaaatgggagttagttata

SEQ ID NO: 27370 - DNA, 112 bp, Homo sapiens
  misc_feature 55: n = A,T,C or G
gaccagagagtgagataaaagagtgagtcagtcgctccctggggaagggagagantgagactgggagaaagagaaagcaccagaaagtgtgtgtaaaacggagtaaagaaag

SEQ ID NO: 27371 - DNA, 337 bp, Homo sapiens
  misc_feature 9, 15, 34, 41, 48, 81, 336, 337: n = A,T,C or G
ctccggccntttatnggcccgggtgtgggagaanaggaaancccttantacacctatttggtgagtgtgtaaattagttcnacctattgtggaaagcagtatggtgattccctcaaagagcctgaaagccagaacctgcccattcaatcccagtgatcccatgactgggtatataccccagaggaatataaatcatcctaccataaagacacaggcatctgaatgttcattgcagcactattcacaatagtgaagatatggaataagtctaaatgtccatcaatgacagattggataacgaaaatgtgatacacatacaccatagaataccatgcnn

SEQ ID NO: 27372 - DNA, 382 bp, Homo sapiens
atattttgttaagtttaccaaaaattaaaatgttttaacttaaataggatcatatcaaatttataggctaatttagggatgattgagatgcacttcaaaatttcatgtgacaaaacatctaaaatagcaaggacatttttcttccctatcatatttgctgcccactcccctccccccaaaaagggaacattctcagaggtcaaactaccaaagatggttactttcctaaactgacttccctctgtgatcttctcccctacttgctggttcctgaggcttccccttttggtctctgatgaaaagggtggggctttggtgaccctgctgtgccatgtctatgactatgcatgcatctggggccaggtgatgtggaggacagaga

SEQ ID NO: 27373 - DNA, 297 bp, Homo sapiens
  misc_feature 226, 290: n = A,T,C or G
gatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagangctcatctttgcgggcaagcagctggaagatggccgtactctttctgactacaacatccagaangagtcga

SEQ ID NO: 27374 - DNA, 424 bp, Homo sapiens
cacagagggaagtttaaaacccaaacttccaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacct

SEQ ID NO: 27375 - DNA, 292 bp, Homo sapiens
gttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatgg

SEQ ID NO: 27376 - DNA, 248 bp, Homo sapiens
aattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaagt

SEQ ID NO: 27377 - DNA, 274 bp, Homo sapiens
tgtggtggctcatgcctgtaatcctagcactttgggaggctgaggcaggtggatcatctgaggtcaagagtttgagaccagcctgatcaacatggtgaaaccccgtctctactaaaaacataaaaattagccgggcatggtggcagatgcctgtaatcccagctacttgagaggctgaggcaggagaattgcttgaatccaggaggcagaggttgcagtgagccgagactgcaccattgcactccagcccgggtgacagagtgagactctgtct

SEQ ID NO: 27378 - DNA, 296 bp, Homo sapiens
  misc_feature 7, 14, 23, 25, 57, 69, 70, 83, 92, 95: n = A,T,C or G
ccgggancttgganttcctgaananctaccagccaccagtgccagcctttggttccntacttccagtcnntcctcaggagaancttcagaanganccttgagtaggccccaaatggttgaagttaagttttcccaataatgtgaccttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaat

SEQ ID NO: 27379 - DNA, 403 bp, Homo sapiens
  misc_feature 156: n = A,T,C or G
gtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggagngggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtac

SEQ ID NO: 27380 - DNA, 203 bp, Homo sapiens
  misc_feature 6: n = A,T,C or G
ggaganctctcatgctgtatagcagagtctgagtatgattagagaaaacacaatttgatgcttagagtttcaagacgtcagagactagtcccagctactcgggaggctgaggcaggagaatcgctggaactcaggaggtggaggttgcagtgagattgtgccattgcactctggcctgggcgacaagagcaaaactccatctc

SEQ ID NO: 27381 - DNA, 466 bp, Homo sapiens
  misc_feature 460: n = A,T,C or G
ggagcatttaagaagcatcctctgccagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcggcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagacntttaga

SEQ ID NO: 27382 - DNA, 383 bp, Homo sapiens
ggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttggcgttgactttaaacagacataagtatccccttaacctgtacctactttttggatttacgctgttggaagctctgactg

SEQ ID NO: 27383 - DNA, 328 bp, Homo sapiens
  misc_feature 17, 239, 283: n = A,T,C or G
ataagaagtctgttgcnagggagccagtattcatgtatatttggcttgtgtgtttatttcgtgtattgagaatgaacacctttactttgcctcattcctagtaccctccctggagttcagattttttttaaaattttgtatgtctcgtctgattcaatctctctgcttttattttatggtcctagttgtactatcaaatccaattacttttttttaggtccccctgattttttttttanagcaagagttcttaacatattacatttttattatgaaaaataanaaagttaggtaaaggaaagaaaagtctaactagagctattttgca

SEQ ID NO: 27384 - DNA, 238 bp, Homo sapiens
  misc_feature 5, 19, 23, 26, 29, 34, 35, 40, 45, 51, 55: n = A,T,C or G
ggctngaggtgggcagatnactngangcnagaanntcaanaccancctggncaanatggaaaaaaccctatctctactaaaataacaaaaattagctgggcatggtggcacatgcttgtaatcccacctacttgggtggctgaggcacaacaatctttgaacctgggaggcagaggttgcagtgagccaagattgtgccactgcactccagcctgggtgacagagtgaggctctgtcc

SEQ ID NO: 27385 - DNA, 220 bp, Homo sapiens
  misc_feature 5: n = A,T,C or G
aaatnagtgtttaagacctcaaagctttaacctcattgtcccctttctcagccctcccaaagtgctggaattaccaggtgtgagcccatcgtgcccctgccgaaattgaattttctaatgacagaattaaaaacatcagaaggcttagtttaggaaggaaagtgacaggatggattttaggcaggtttggtttgagctgatggtcaagaaattgggtatc

SEQ ID NO: 27386 - DNA, 179 bp, Homo sapiens
tgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagc

SEQ ID NO: 27387 - DNA, 126 bp, Homo sapiens
  misc_feature 4, 5, 55: n = A,T,C or G
aganntaaatttaatgtttgaatctaaatcattgggcaaacttctaataataacnattaataataggttaccaggaaagcccagcccagaggaagtgtcagcacctttaaaattctagaccccccc

SEQ ID NO: 27388 - DNA, 295 bp, Homo sapiens
  misc_feature 8, 185, 196, 235, 245, 258, 281: n = A,T,C or G
ggcagtcncagaacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaanaaaggaaaatntcccaaggactaatctgatcgggtcttccttcatgaacnaatgcaggantttgggaactganctgtgcaagtgctgaaaaagganatttgtttgggagg

SEQ ID NO: 27389 - DNA, 470 bp, Homo sapiens
ctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaggcatcttgagaggaacagaaaggataaaggatgctaaattccgtctgattctaatagagagcccggattcaccgtttggctcgatattataagaccaagcgagtcctccctcccaattggaaatatgaatcatctacagcctctgc

SEQ ID NO: 27390 - DNA, 421 bp, Homo sapiens
agataagccatgaagatggagaaaggggaaatgtatggaaattctccaagatttttaggtgccacaaatttgactatgtattctaagatctcaaactgtcagataaataatctgcatgtgtcttatactaacactgatgttccaatacaagtgaatagttccaaattggttcttccaggaagttcaagtttgaatgtaacttcagatcatatgaatacagaaattactacttataagaagaaattgagtactaatcagccatgccataagactgtaacagatgaagctcagagcaaccttaacacaacagttggattttcaaagtttacatttacaaggatgaaaaattctcagattctttctcagtttaatcaaaattgtatacttggaagtttgtctgataccaaaattacacagggtg

SEQ ID NO: 27391 - DNA, 385 bp, Homo sapiens
  misc_feature 29: n = A,T,C or G
tatggccgggggccggagccttgaggaanccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagtttaaaagttg

SEQ ID NO: 27392 - DNA, 472 bp, Homo sapiens
aagaaatagaaacaataaattaaatctataacaaaaatagatttaaatcctcaacaaagaaaagaaagcaagacaaagctaaaggtacagacaatggaaacacgaaataaaagaggaattcgtcaggattattaatcaaagggctcatcagagttattaattggagctccacatttggagctgtgcctttatttttcttttctccttgtgttaagtagtggatagcagctgtgtttacccacaaactaaatccttgagtgtgggtgctagacccagagaggtaggggcagtgcctcagtaatgtgctgactgccaggtgggttaagaaagcccacccacacaggagacaagccacttgtctgtccctattaatcactggaaacagacaatggtaaacaaaagagctggcacacagagattctcaaacaaaagatgagcatataattatgacacaccgcaatatgaagtaaat

SEQ ID NO: 27393 - DNA, 231 bp, Homo sapiens
  misc_feature 4, 14, 18: n = A,T,C or G
gagnccttgaggcngccngcgccaggggccttctgctgagggggcaggcggagccttgaggaaacccgcagataagtttttttctctttgaaagatagagattaatacaactaccttaaaaaatatagtcaataggttactaagatattgcttagcgttaagtttttaacgtaattttaatagcttaagattttaagagaaaatatgaagacttagaagagtagcatgagg

SEQ ID NO: 27394 - DNA, 104 bp, Homo sapiens
  misc_feature 1, 7, 29, 30, 42, 43, 52, 72: n = A,T,C or G
naaagcnttttaaataaaagtcttgggannacctactaaacnnaaagagtantaaaacattttctgtaggcnagcaattagccagccaggataaaaaaccaaac

SEQ ID NO: 27395 - DNA, 443 bp, Homo sapiens
gaactcggtggtggccactgcgcagaccgacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaag

SEQ ID NO: 27396 - DNA, 405 bp, Homo sapiens
  misc_feature 2: n = A,T,C or G
cnttatggccgggcaatatatattataaattaatataaatttaagggaagctctatgtaaggagacttagagccaaactgtttaagctgtatcatcccaacaaagtatcctttcatgaacggggcatgcaatagcttaagaattgctaggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgcctttctgac

SEQ ID NO: 27397 - DNA, 294 bp, Homo sapiens
  misc_feature 9, 10, 27, 28, 29, 30, 45, 58, 294: n = A,T,C or G
ctccggccnnttatgggcccggggagnnnnaagtaccttttcacnaccttgttaaganggagttataacctgtcataccatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgacccaaaggtctaaataaagagcagtttcccacan

SEQ ID NO: 27398 - DNA, 468 bp, Homo sapiens
catctggaaggatgctcgagagaaaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagag

SEQ ID NO: 27399 - DNA, 178 bp, Homo sapiens
gagcaatggagagaaacaagccctatgggggaggtgcagaaaatgaatgggatctagaaagggagttgagtttggaagttaaggaagtcaaagaaacaaatacatccaaaatggatttagaatctctcctctaaatccatcctttccaaaaaatgtttcctatattgagagatttggg

SEQ ID NO: 27400 - DNA, 379 bp, Homo sapiens
aggttttctcctgataaactgattccgtaagaaatttcagtacataccaagtacctggaaagttcttcagataagttaatagatccaaggagatacatgcctcagtgagataaactgacctttttactagctaaactatttagccagagcaatactctgtagaactgtgcctttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtat

SEQ ID NO: 27401 - DNA, 121 bp, Homo sapiens
atttttttagtggggatgggatttacagtgttacccaggatggtctcaatttcctgacctcgtgatccgcccgcgtcggcctccaaaattgctgggattgcaggcgtgagccaccgcgcct

SEQ ID NO: 27402 - DNA, 310 bp, Homo sapiens
cagccctatttctttaaatagtttaaggagacagcacattgtttgacagttctgcaaacataaaaaataatttatctcacacttaatttttatctgaagacaagtttaatattttcaagcattgcatttttatttttaagttcttacatcctttttgtttctcttaatgtcattttggcttcaaagggtataattttgaaattatgagtactgtaggacttgttagtatttcttctttgtgtgtataatgtttcaagaactgttgatggctaaatgtcatttttatactttttggattcataacagttca

SEQ ID NO: 27403 - DNA, 401 bp, Homo sapiens
ggccggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttcctttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttg

SEQ ID NO: 27404 - DNA, 320 bp, Homo sapiens
  misc_feature 2, 12, 319, 320: n = A,T,C or G
cnccccgggaanttcggccattatggcccggggtgaagagtgagactctgtctcaaaagaaaaaaaggaaaaataatggggtctcactatgttgcccaggctggtctcaaactcctggactcaagcaatccttgcatctcgtcctcccagagtgctgagattgcaggcatgggccattgtacccggctatcttatcttctttatatagatatctaataagatgtaaaatactgacctgcattatctccatgttaacatttacacttcaaaatctgtaaacggacccacgttcatacgcgtgaacagaaatctttcagcnn

SEQ ID NO: 27405 - DNA, 388 bp, Homo sapiens
caagtccttgtgtctagtctcaggctgtgattttaagggagccccaaactaagagagcaatattattaaaattaaagttttgaaatgaaaagcatttgaaggtccactagcagtctccttaaaataccacctactaccttttggtattaccatttatacctgagccagaggaaaggagaattccaaaaaaggccttaaaaaccctctgacccacaggaaatagctgccatctagtcaggctgggcaaagggcttagtaatacagaaagtgaaaaggggctcatgggggccttagcagggtgactcaatttagtgggtgagaaggaattcttgtttaacttaggggaaaactactgggtaatattcttttccctagtcataatggttac

SEQ ID NO: 27406 - DNA, 413 bp, Homo sapiens
aatggacaatagaaagcctcattagtcctgatggttctcgtaaaaaccccgctagaaactgcagagacctgaaattctgccatcctgaactcaagagtggagaatactgggttggccctaaccaaggatgcaaattggatgctatcaaggtattctgtaatatggaaactggggaaacatgcataagtgccaatcctttgaatgttccacggagacactggtggacagattctagtgctgagaagaaacacgtttggtttggagagtccatggatgggtggttttcagtttagctacggcaatcctgaacttcctgaagatgtccttgatgtgcagctggcattccttcgacttctctccagccgagcttcccagaacatcacatatcactgcaaaaatagcattgcatacat

SEQ ID NO: 27407 - DNA, 416 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttg

SEQ ID NO: 27408 - DNA, 176 bp, Homo sapiens
  misc_feature 10: n = A,T,C or G
acagggaccnaatatttgtattcaaattacatttctggtttcccattgtttcacaatgagttctaataaatgggatttactataataatccaagtatgacatagccggtatgctttcatgaatgtttttatgtagattttcctcccatgaacatgagtaaataaatctgtttcctg

SEQ ID NO: 27409 - DNA, 430 bp, Homo sapiens
  misc_feature 16: n = A,T,C or G
ggatctacaatcaacnaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcgg

SEQ ID NO: 27410 - DNA, 471 bp, Homo sapiens
atagtgatgggatatcaattgtgatattaaattaaaggactacagcaccactacacacctattagatctaggccagaatctggaagactgacaacaccaaatgctgatgaggctgtggggaaagaggaactcttatttattgttcgtgggaattaaaaatggtgtagccactttggaagacaattcgactattccttgcaaaactattcaatctagcagttgcactccttggtatgtaacccagaaagctgcatgtactacactcctcagtatgtaacccaaaaagctgtggtatgtacacaaaaagctgcacacagatgtttatagtagctatattcataattgccaaaaattggaagcaaccaagatgtctttcagtaagcgaatgaataaataaactgtggtacatttagacaatggaataatatccagtgctaaaaagaaatgagctatcaagccacgaaaagacat

SEQ ID NO: 27411 - DNA, 427 bp, Homo sapiens
tgatttctcttgcttaatccgtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttg

SEQ ID NO: 27412 - DNA, 430 bp, Homo sapiens
  misc_feature 3, 16, 31, 36, 56, 59: n = A,T,C or G
ccngggaattcggccnttatggcccggggtnagaanccgggagtctccgagagaanaanaagcaggtggaaggagaggaagcggatgcccgtggggtttacagcaggaaaatccgtggagacagcagatccgagaagcggcgatgtttgcgtagaaccctgtacgtgcttccttcggcctgtcggtaatgtggttggggattttcttttttttaagtgaaggctaaagaactgaaatgttttgctccgtaatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgac

SEQ ID NO: 27413 - DNA, 400 bp, Homo sapiens
ggattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgcgactttgtcacagcccaagatagttaagtggggatcgagacatgtaagcagcat

SEQ ID NO: 27414 - DNA, 435 bp, Homo sapiens
aagggaaagatgaaaaattataaccagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgttcaagctcaacacccacta

SEQ ID NO: 27415 - DNA, 147 bp, Homo sapiens
gtgatgtgcccgccttggcctcccagagtgctgggattataggcgtgagccaccacccctggttgggaagtaaatttacactccactttagggataaaacagtcagcaactcttccaagcttctccctaaaacctcacctcatgcct

SEQ ID NO: 27416 - DNA, 452 bp, Homo sapiens
  misc_feature 83, 84: n = A,T,C or G
gttgccaaaatttaaaatgtttccgtgatatctgccagtgaatgagagatatagtagatttctctaaatacaagtaatacttnntaggatttggaagtacaatttaaggtacttattaattataaaaatcttctatggtgcaactttccttgctatgcacttaatttatacccagatcatttcacaccacaacccacacgagtaagaccacaaaaaaaagttcttatctcatgaagaatctttgctatttaataattttattatatgtggaagctttagaatactgagctactttattatataaaaatattttattgtatttatcttaagcagctaacacaatatctttagttcaaagtttgtcttcagtctataaagacattcttgtttgactgtttcaaaaatatactaatttatcccagtctagaggaaacctttttaggattctaaga

SEQ ID NO: 27417 - DNA, 385 bp, Homo sapiens
gtgtgtgttggcggccgagaagctggcattcacacgaaggccttctgaacgttcccagagaatttaaaaatgtcttttgcttttggtatttctactgtctcacatctttgggaattggtaactagtatctatgccatagttagaaaactttatagtttaccacatgattccatttgtccagagttgctgttcccacaccaaaccagataatgaggtcactatttaatttacagtgactcactgggccctttcactgtgtactgagactggatgcatccttgcaataaaaaagaggttgatcacgacaaatgtgaaccccgccgttataaaaacagccatcatggctgtaaatgccaaaaagcagtcagtcttgtaactcgaaaga

SEQ ID NO: 27418 - DNA, 352 bp, Homo sapiens
  misc_feature 11: n = A,T,C or G
aattgccaagnagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaaga

SEQ ID NO: 27419 - DNA, 408 bp, Homo sapiens
  misc_feature 4, 5, 29: n = A,T,C or G
gtgnntgccttgttcatctctatctgccnacttatagcaaagtatctggaccattaattggcattcaatatttatcgagtagatggatggatgatagatagacggataaagattggaatgtacatgccccttttggcatatacaaacatcaggtgaacttttttctctgcctagggaggaagctattcctagcaagaagacaacttaatactctagattattcctgggctactgaggttactaaataagagcatcttatttagctctgctgctgataagaccatgggaagttatttacatttaggagtggtatcttactaataccaactttcacaggtacttgggtggattccagatttatttccctgctatagttgcattatttgctttgtatgatatcctccttac

SEQ ID NO: 27420 - DNA, 398 bp, Homo sapiens
  misc_feature 4, 6, 29, 55: n = A,T,C or G
gttncnaatgatggataaacttgtgctgntgttttggatcttatgatgctgagcntgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcat

SEQ ID NO: 27421 - DNA, 350 bp, Homo sapiens
  misc_feature 6: n = A,T,C or G
gaggcnttgaggcagccgcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatag

SEQ ID NO: 27422 - DNA, 311 bp, Homo sapiens
  misc_feature 6, 43: n = A,T,C or G
gaatcngaggaaataacagaagaacattctgtttctgaaaatnaagagtcctcctcctcctcctcctcttcctcttcttcttcaacaattcggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacatgtctaccacccaacacaataaagtcagcacatctcccaagatcac

SEQ ID NO: 27423 - DNA, 390 bp, Homo sapiens
aagaatttttccactcttctgtgaattattttttgactttcaattataatgaagttattaatcttacaaaggctcgctttgtaaagagactaatctgaataaacttgcttgtatacaataagtgccatggcaaaaattaagagtacagttattatcagagactaaaataacaatttaattttctagaaatagaaaattaagaaaaataacttttaatgctgggatttgacattaagaaatgaatgacaaaaatgggaccaaataaaatgctgtaattggccagacatggtagctcatgcctgtaatcccagcacttggggaggctgaggtggaaggatcacttgagctcaggagttcaagactagcctaggcaaaacctggtctgtatct

SEQ ID NO: 27424 - DNA, 304 bp, Homo sapiens
  misc_feature 32: n = A,T,C or G
atttgcattaagctcataacaaataatataancacaaattataatgtgttaaaataactcaaaagtaggttttttgcatgagttttcagtattttaaattaacagtttcagcacagtctcctcaaaggaaattagaaaatgtacttgagggttttttaacctttttatgattccctgtcagcctttcatgttgcttttgtttctgttatcttaatgtgaaaattatttttgtatgtcatggtcagtctggggttcacatacccagataaatataatttttatagttttatacaatatttgttac

SEQ ID NO: 27425 - DNA, 170 bp, Homo sapiens
  misc_feature 5: n = A,T,C or G
gcatncggttctgttgtagtgtatttgttttctcccatgccaagaatttgagagaccatggttccctgaaaagagtggtcccccaaggaatgtccgccccgacgtttctgggcaggtcctccagaactgccttggattttgaaacaaaagcttatcactgtccctacact

SEQ ID NO: 27426 - DNA, 225 bp, Homo sapiens
ggatctttggactacgttcttggctccagtacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgc

SEQ ID NO: 27427 - DNA, 390 bp, Homo sapiens
  misc_feature 33: n = A,T,C or G
gaatgacgaagatgctgataatgatgacaactntggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattat

SEQ ID NO: 27428 - DNA, 183 bp, Homo sapiens
  misc_feature 7: n = A,T,C or G
ataatcnctgatgacatgtgggaaggaagagagtggattacatcacagcatggaacttcagattaaactctgagtgtccctgtgcttaaaatattatcactcacccaccatgacttcccgcagtccccaactcagaccagctcactggctcttgtctctctttcctccttagccccactcccc

SEQ ID NO: 27429 - DNA, 369 bp, Homo sapiens
ggctcaagcaatctgtcttctcggcctcccaggtgcttgcattgtaggcatgagccactgtgcccaggctcaatttctgaatgtccatctaaaaaaataagtacctgagggctgggcgtggtggttcatgcctgtaatcccagcgctttggatggccgaagcaggtggatcacttgaggtcaggagttcaggaccagcctggccaacatggtgaaaccctgtctctactaaaaatacaaaaattggccgggcgtagtgatgcacacctgtagtcctatctacccgggatgctgaggcgggaggtggaggtaacaatgagccaagatcgcaccactgcactccagcctgggtgacagagcgagactccat

SEQ ID NO: 27430 - DNA, 215 bp, Homo sapiens
  misc_feature 5, 30: n = A,T,C or G
ggaanataggaatgtcctttggaaatgagnaattgaaacccaagaagtcagggctggagatagagatttgagagttatgcaaatatactcagatcatgttcaagatcacacaggactatgagatttacaactgagtgtatttgttgaagcaagtagaaagctgaggccagggctcctggtgggtggggaggaaaatcaacaaagattttcttttg

SEQ ID NO: 27431 - DNA, 326 bp, Homo sapiens
  misc_feature 5: n = A,T,C or G
tgganaaaacaaggtagggttgtatgtatgcagctttctggggtataaaccacggattttgtctctcttctattttattgtgtccaagtggcatttagcataattgactagtcctgttccactacagtaagctaatcaagtacttttagtttgttttgaagtttaagctccaaatggcattttggcccagtttaaatcatcaatacagttttttctatatttctgtgaaatacctatatgttcataacaaataagatacttgacagagttacatatcagactactaagaagaggagacctctgtgattaatcttagatagttagat

SEQ ID NO: 27432 - DNA, 228 bp, Homo sapiens
cagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgcctttctga

SEQ ID NO: 27433 - DNA, 335 bp, Homo sapiens
  misc_feature 6: n = A,T,C or G
ctgaancagtatacaaaagaaacctgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaagacttccagatgtctaaaagattctttaaactactgaactgttacctaggttaacaaccctgttgagtatttgctgtttgtccagttcaggaatttttgttttgttttg

SEQ ID NO: 27434 - DNA, 454 bp, Homo sapiens
  misc_feature 2, 28: n = A,T,C or G
tncaagatggctgcacgaaacataccgntaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggccggaaactaactggtgtgagtcaaatgccccctgagtga

SEQ ID NO: 27435 - DNA, 247 bp, Homo sapiens
  misc_feature 207, 220, 230, 244: n = A,T,C or G
ggccccaccgcagaacattcttctcttcaaaggatgcaatagtagaaagccacttattttaatgaaaaaaagtaaaacttcgttctttatcagcctcatgcctgaatcaaatttttaattattctgaaactgctgctgtttaaagtggaatcttttagtattataccggcatcactttagattttgtaagtcaaaattgaaatgaangccatagattttnttttataacncccccccccgggcnggg

SEQ ID NO: 27436 - DNA, 455 bp, Homo sapiens
ctctctttgaaactgtaggacaaggcccgccgcctagcaaagactattaccagttactggtcacccggtctcaggtaatctttagatggtggaagatctctctaaggagtgagtatcgatcaacaaaacctggagaagcaaaagaaacccatgaagacttcctagagaattcacatcttcaaggtcaaactgccttaatatttggtgcaagaatattagactatgtcatcaatttgtgcaaaggtaaatttgacttccttgaacggctctcagacgatttgctcctgactatcatttcttatctggatcttgaagatattgccaggctttgtcaaacatcacacagatttgcaaagctgtgcatgtctgataaactgtgggaacagatagtccagtcgacctgcgacaccatcactcctgacgtgagggccctggcggaggacacaggctggaga

SEQ ID NO: 27437 - DNA, 384 bp, Homo sapiens
  misc_feature 7, 14, 34: n = A,T,C or G
aagttcngtacagnataacgcacagcgcacagtngcatactatacacgccctactaaatcttgctttgttcccttaacagcacctatgcatcttggagatagattgtcccagtctgcctcatttttaaaaactgctgcataatatcctcttgtaatccacaaagggaatcccagacccagcctggggggccatgggtcatcactttttacaacaagctctaaaatcttccacatgtaccataatcaaggcacttcagaacaaccctaggttcctcatgcctctacttttattagcctgggcctgacatagttggacattgaatagtcacttctgggggctggtggaaataatttaccatgagtgactgccctaaagtatactct

SEQ ID NO: 27438 - DNA, 308 bp, Homo sapiens
  misc_feature 6, 7: n = A,T,C or G
taatgnntttaacaatatagcctcaaatatattagccagaaatgaacagaactaaaatgagaaaagacaagtctgcattcccagattttaatatactcagtaacagaacagcagccatgcaaaaatacgtaaatatgtaaagattggaataatactttaaaacttaacctaattggcatatatgaaacagaatacccaacaactgcaaaatacacattattttcaaatgcagatagaatatttatcaaaactgaccatattccaagtcataggaatggaatatattctttggccatgtatcattcact

SEQ ID NO: 27439 - DNA, 490 bp, Homo sapiens
  misc_feature 7, 31: n = A,T,C or G
ggctccncatttggggacgctctcagctctnggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacag

SEQ ID NO: 27440 - DNA, 208 bp, Homo sapiens
  misc_feature 16, 32, 33: n = A,T,C or G
tagaaccttagttcanctttaaattgtgcccnnagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatccc

SEQ ID NO: 27441 - DNA, 425 bp, Homo sapiens
  misc_feature 6, 96, 111, 114, 136, 149, 175, 189, 244, 252, 259, 277,300, 316, 329, 349, 381, 412, 417: n = A,T,C or G
gtcatnccttagtggccccacgacccctctgtttgtattcctgctccacttatctatacttttttgggtaatcatcccacttttttttttcttganatggagtctcgctgngtngccaaggctggagtacaggggngcaatctcagctnactgcagcctcctcccgggttcaagngattctcctgcctnagcttcccaagtagctgggattactggcgcacgccactacgcccagctaattttngtattttnagtaaanacagggttttgccatgtnggccaggctggtcttgaactctngacctcaacctgcctnagcctcccaaagngctgggattacacgcatganctaccgcgtccagccccactttttttctactnttgaaaaaaacaactttctagtccatgaggnacttnggctccat

SEQ ID NO: 27442 - DNA, 155 bp, Homo sapiens
agtgcccgtcgtgttttgttaatgttttttatgatgcttgtagtcaaaagaattacctaacagttctctttatgaaatagctgggtccaaacaatttaatgagtatttatgatcaagcactttagtagcagtttgaagaaataacgtgtatccac

SEQ ID NO: 27443 - DNA, 490 bp, Homo sapiens
  misc_feature 20, 29, 34, 35: n = A,T,C or G
aattgacaagtggtgaaagnagtcctagnacagnnctattaaaaaagaaataaagagcattggaaaagaggaagtcaaattgtcactgtttgcaaatgacatgatcttatatttaggataagctaaagacttcactaaaaagctgttacaactggttaactatttcagcaaagtggcagaatacaaaatcaacatacaaaaaccagtagcatttccatatgccaatagtgaacaatctgaaaatcaaggaagcaatcccattcaccatagctacaaaaatataaaatgcctaggaataaatttaacaaaagaggtaaaagatctgtacaataaaaactgtaaaacactgataaaagaaattgaagaggacacaaaaaataaaaaaactcatattcatgaattagaaaaattaatattgttaaaatgtccatactacccaatgttaactatagactcaagacaattcctatcaagtgacattcttcacaga

SEQ ID NO: 27444 - DNA, 200 bp, Homo sapiens
  misc_feature 7: n = A,T,C or G
agactcngtcttaacctactttaccaagtattccagtagcaaagcacccaaaagtaatcgcaataaaattccaatttttgtaggccgggcatagtggctcacacctgtaatcccagcactttgggaggccgaggcaggcggaccacgacatcaagagttcaagagcagcctggccagcatggtgaaaccccgtctctact

SEQ ID NO: 27445 - DNA, 295 bp, Homo sapiens
  misc_feature 32: n = A,T,C or G
aataacgatctatttggaaagtcagacccatncctggaattccacaagcagacatctgatggaaactggctaatggttcatcggacagaggttgttaaaaacaacttgaatcctgtttggaggcctttcaagatctctcttaactcactgtgttacggagatatggacaaaaccattaaggtggagtgttatgattatgacaatgatgggtcacatgatctcattggaacatttcagaccaccatgacaaaactgaaagaagcctccagaagctcacctgttgaatttgaatgcc

SEQ ID NO: 27446 - DNA, 275 bp, Homo sapiens
  misc_feature 30: n = A,T,C or G
cacggcggctcatgccggtaatcctagcantttgggaggccaaggtagacagatcacgaggtcagcaattcaagaccagcctgaccaacacggtgaaaccccgtctctactaaaaacacaaaaaaattagccgggcatagtggctggcacccgtaatcccagctactcgggaggccgaggcagaagaatggcgtgaacccaggaggcggagcctgcactgagtcaagatcgcgccctcgcactccagcttgggcgacggaggaagaccctgtctc

SEQ ID NO: 27447 - DNA, 359 bp, Homo sapiens
ggagcagaagcaaaggagctagcagaataggagaattaggttgcctctttctggcctttggttggggcactctttaaaaaagtgccagatccaagagcccagggggctggctgtgagtgccctcatgtggatcagctatgatcagactgcttcacgcctgtgacctgccctgtataaatatactgccatgtataaataatggccccatatatatgtaatctggaaggataaacatcaagcttaacactggcaacctgcagggagggaagtggaattgggtgtgtatgtgtgtgtgtgtttgagaacctgtattttattactccgcacgtctttattgtttgatttttttcataatgaga

SEQ ID NO: 27448 - DNA, 234 bp, Homo sapiens
  misc_feature 29: n = A,T,C or G
aattcaggtatgggcttactggactccancatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctat

SEQ ID NO: 27449 - DNA, 295 bp, Homo sapiens
  misc_feature 5: n = A,T,C or G
agtgnaacaccaccgggagctaatcccacttaacataaactacagtgacttagagggaacaaactgtctaaccctgagctctcttgtttcccaggaaataaatcaggatgaagtcaagagacatcaaggagtttacattaaaaggtcttactaagtgattgaaatattcttaaactggctgggcacagcggctcatgcctttcatcccaatactttgggaggccgaggcaggcagatcgcttgaggtcaggagttcgagaccagcctggccaacatggtgaaaccctgtctctac

SEQ ID NO: 27450 - DNA, 235 bp, Homo sapiens
  misc_feature 23: n = A,T,C or G
ctgctcactccccttccaccctnttctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcccgagtgtgtctgctcactccccttccaccctcagcggatgataatct

SEQ ID NO: 27451 - DNA, 169 bp, Homo sapiens
attattgaatttgttagactctaaccttgaagtactaactaagcttgctataaatatactgtttctcatctttgctgtctaccttgttgttaatggagagtcactttgtagaaaaaaatatactgtttctcatctttgctgtctaccttgttgttaatggagagtcact

SEQ ID NO: 27452 - DNA, 487 bp, Homo sapiens
  misc_feature 29: n = A,T,C or G
cactcctcagatctcatcttgaattcctncgtgttgtgtgagggacccaatgagaggtaattgaatcatgggggcgggtctttcatgtgctgttctcgtgatagtgaataagtctcatgagatctggtggtttttaataacaggagtttcccagctcaagctctccctttgccctctggctgattgtgaggcctccccagccatgtagcactgtaagtccattaaaccactttttcttcccagtcttgggtatgtctttatcagcagcatgaaaacagacaaatacaatgagtaaaaggaaataaaaaagaagcagtcacaatcctttcatgtaatttgtcaacaagagggtagatgcagcatcatggaggaaacactttacaatgctttgaatattacccaaatcaaattgcccttaaaaaagtaaagagaaattaaaacagtcatgaagaaaagagcctcgaattaaaatagagacttttagaga

SEQ ID NO: 27453 - DNA, 419 bp, Homo sapiens
  misc_feature 13: n = A,T,C or G
tatggccggaatnaaggccaaaaagtgtttaactctatgttcttattttgacattgcttattagtgtccaattattatttggaatttgtatacaacttctttttctctgacagcaactgagttatgcaaaacagctataaaaatgatttcaagaaagatagacaagagtccttcctattgaaaattgtaactttaattttcagatagttttatatgaattgccccatttgattttcagaacaatagtatatagtatggcaggcattttcacataaatttgactaaataaattattccagaaactcaagtgggctattgtgaggattagaagtagaagttccatctgctcaataaatactaaccactattgctattattttatacatatgagaagtgaggctccaagtggttatggcttg

SEQ ID NO: 27454 - DNA, 420 bp, Homo sapiens
  misc_feature 31: n = A,T,C or G
taccccaataaagtataggcgatagaaattnaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagag

SEQ ID NO: 27455 - DNA, 467 bp, Homo sapiens
  misc_feature 5: n = A,T,C or G
ggtgnaagaaacgcggaacctggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccact

SEQ ID NO: 27456 - DNA, 354 bp, Homo sapiens
  misc_feature 23: n = A,T,C or G
aaggtccatgaattagtagagtnatgtggtgggtgtgctgtgtcagaaaggcttcactagcagtgtatacagaatgagtgggagtgagtgagccgtctggaggtaggcacggtcctctggagaactgtagtaattcacaaaggagaggaagaaaactcaaaatatgatgatagctatggggtcgaaagtaagataagaaacacaatgaatagttggcggtcctattgattaagtggagaaaaattatattgaagttgcaaacctaggagaatggccagataatacagattatgaaataaatggagaagggaccaattttgaaaaagttaattttccttaaaaacataaggaaat

SEQ ID NO: 27457 - DNA, 437 bp, Homo sapiens
  misc_feature 30: n = A,T,C or G
attgcccctgtattaaacttcctcagaccntgaaagaaatcaccgagatattacagagaaattcaaatagcttgatttcagggttaaaataattgatcgccactgtgatgttagaggacttttggttgcaggttgctgactatcaaaatccaacataaggcagggtacagtggctcatgcctgtaatcccagcactttgggagactgaggcaggtggatcacctgaggttaggagttcgagaccagctggccaacatggtgagaccccgtctctactaaaaatacaaaaaaaattatccaggcttggtggtgtgtgcctgtaatcccaagcacttgagaggctgaggcaggacaatcgcttgaacctgggaggcagaggttccagtgagccaagatcgtgtcactgccctccagcctgggcagcaacagtgaaaact

SEQ ID NO: 27458 - DNA, 439 bp, Homo sapiens
  misc_feature 29: n = A,T,C or G
gggccgagcttcgatcttgcctaggcgcntagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctc

SEQ ID NO: 27459 - DNA, 420 bp, Homo sapiens
  misc_feature 30: n = A,T,C or G
gacaaccttagccaacctttacccaaatanagtataggcgatagaaattgaaacctggcgcaatagatatagtaccgcaagggaaagatgaaaaattataaccaagcataatatagcaaggactaacccctataccttctgcataacgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactagga

SEQ ID NO: 27460 - DNA, 334 bp, Homo sapiens
  misc_feature 17, 44, 157, 168, 173, 232, 247, 261, 282, 316: n = A,T,C or G
tatggccgagaaaaagncaatcgtgtgtgcatatgcataagtanagagaagaagctagagagagaaggaaatgatgtgagaaattaaatcctttccatactacaaagtcagtaaataatgtctgtgactgaaaaaaaaaaatcaaggaataacattntaatcatgttntttanaaatctggaaacaaattgctgaaagaagtagttgaaagagttgcaagcggttgtttttntggagcaggaatcancagggaggcaggtncttggttttcataagccctanagttctttggctttttaaaataggtacctgtaanacttgttcaatccatagc

SEQ ID NO: 27461 - DNA, 180 bp, Homo sapiens
cagcacaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattac

SEQ ID NO: 27462 - DNA, 366 bp, Homo sapiens
  misc_feature 8: n = A,T,C or G
aatacttnttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaatttttcattttattcatttaaaaactagaataacagatatataaaagtgttaatctttgtgctatatggtatgaaatacaatattgtactcagtgttttgaattat

SEQ ID NO: 27463 - DNA, 334 bp, Homo sapiens
  misc_feature 22: n = A,T,C or G
gctgagcctggagccggtgtgnctttcacatgaccatgtggcaatctggaaaagtccatgtgtcttaagctctcagtgttgtacaagctgaaaggagaaagaaaacaggaggacgccaatggtacccaaagccaacttaactggggtctcagtgaaaaccttaggactttacaactacatctacagatgccctctgcattactctggtgcacgttttatggcaggaatcctgttggcagagatgaccacagaggaggatcactcagaaagcattttctcaaaaactataatttctttagtctcctgttcaggtggataattaaataaatggtga

SEQ ID NO: 27464 - DNA, 370 bp, Homo sapiens
  misc_feature 20, 22: n = A,T,C or G
ggctctaagctgcagcaagnanaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcaga

SEQ ID NO: 27465 - DNA, 377 bp, Homo sapiens
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttta

SEQ ID NO: 27466 - DNA, 424 bp, Homo sapiens
  misc_feature 32: n = A,T,C or G
caggacacctggctttcatgacccagtacaanctggttccagcgtatcactaggcacagtgcactgagggttatacagtgatgaattagacaaaccagatagcctttggaaactccagctgagattagctaaaatgctatttcagatatgtatcttaatgaactggcaagagagtcaggattctaagtggaagtgggaacctggagagacaaacagaacactaatgccagatttttgcagtgagaacgtttgccaaactaattgaacttaagcattgatttttcactccctcgaggggctttaggataggagacaaaacccagggctctaaacaacatggggagtctgataactgaggacaccccctctgtggggggaaaccttagtataagggtaaacaaacatataaacctgccaccttcat

SEQ ID NO: 27467 - DNA, 389 bp, Homo sapiens
  misc_feature 260: n = A,T,C or G
cacgccctgctaagttttgtatttttagtacagtatggggtttcaccatgttggccaggctggtcttgaactcctgacctctggcgtgagccactgtgcccagcctaccctctttttaagagatggggtcttgctatattgctcaagctggacactcaagttatccttctgcactctagcctgggcaacagagcgagactccgtctctgaaaaaaaagaaaaagaaaaagaaaaaaaaaattaggtaaccattttttggngactgaaaccctattgatctattctctaaatgtctgccatttgaagaatcccagggcaaactactatgcttttattggctttgtaaattgggacttccataagttgggcttccaaccacattagcattg

SEQ ID NO: 27468 - DNA, 420 bp, Homo sapiens
  misc_feature 6, 7, 33: n = A,T,C or G
aatgannaacacagtttgtcctctccttttatncaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggaga

SEQ ID NO: 27469 - DNA, 348 bp, Homo sapiens
  misc_feature 5: n = A,T,C or G
tgacnaacatggtgaaagccttctctactaaaaaaaatacaaaattagctgggtgtggtggtgcacacctgtaatcccagctactcgggaggctgaggcaggagaatcgcttgaacctgggagacagaggttgcggtgagccaggatcgcaccattactctctagcctgggcaacgaatgaaactccgtcttggggggtagttttcattatcattaaaacataagcaaatatataatcagtgttatatgctttatctttaacgtaacagcctagtgagtagggtttgaagatggatgccagtgttgactaagtatcttatcatgcagaatctattaatgtctggtttg

SEQ ID NO: 27470 - DNA, 116 bp, Homo sapiens
aaggccaaggtgggcggatcacttgaatgggagggggaaaggggagccggagattgcggtgagccaagatcgcaccactgcactccagctgggtgacagagcgagactctgtctct

SEQ ID NO: 27471 - DNA, 204 bp, Homo sapiens
  misc_feature 8: n = A,T,C or G
aaaggtcnaaccccatctctactaaaaatacataaaattagctgggcgtggtggcaggtgcctgtagtcccagctacttgggtggctgaggcaggagcatggtgtgaacccaggaggcagagcttgcagtgagccgagattgagccattgcattccagcccaggagacagtgtgagactctgtctcaaaacaaaacaaacaagc

SEQ ID NO: 27472 - DNA, 321 bp, Homo sapiens
  misc_feature 29: n = A,T,C or G
gacccgcttttcatctgtcccgctgcgtnttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcaggcaagtgcagctgctgtgcctgatgccaggacagctgtgctctcagatgtaaatagagcaacctatataaacctggatttttttttt

SEQ ID NO: 27473 - DNA, 375 bp, Homo sapiens
  misc_feature 252: n = A,T,C or G
ctcagcttcttctttcattctaatccttgctattaagaatttaagacttgtgcttacaatatttttgacctggagtggatctacttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggntgacaaataaatagttgctcttctacactaggggtttcacctgcaggtttgacacgcagttgctcgcttttcctgccctgtcaagcttctctgttctggcgtgagttgtgaaagagttgaaga

SEQ ID NO: 27474 - DNA, 396 bp, Homo sapiens
  misc_feature 5: n = A,T,C or G
aaaanaccactatgaaaggaagctcaactccttaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatg

SEQ ID NO: 27475 - DNA, 311 bp, Homo sapiens
  misc_feature 23: n = A,T,C or G
atctattgggattcgtgtttttntgagggattccacagtaggttactgatgtcgcacctcagggtgtgtctcaaaagtgagacttgaacatagcacagcaggatgtcggggtgacacaacctgttgtcccttctctttacctacagtaggctcccttggctgttttgtttttgttgtgtttttgtttgtacacagagtctctgcactccagctgggacaacagaatgagaccctgtctcaaaacagacaaacaaaaacccttatagttggatggagaaactgaggctgggagaggggacaggacggaggtt

SEQ ID NO: 27476 - DNA, 437 bp, Homo sapiens
ctcccacgcagttggcgaggccagcctcactcctgcagtgctctgctaatagagccgagtttccatccaggcagcctgtgcacaatgaactcagacctgccccaggccataggcttccctgctgagaaagcaagcacagctttcaggcctcgcccctacctgtctgcccacagtgttggtagctcctgccctcatatctgcagcagtttccacccaccccccagattctgcttaagaaagttcacgcccagtggcaattattataaaattcagttggaagcttctttcaccccatgacccctccctaattccactggctgccttcctggaggcgctctgtgagatacagttatataccttccctgggctcaagctagagaaactgggagtgcctataaggcttttcccattgctgctactattgtatttcacccaga

SEQ ID NO: 27477 - DNA, 208 bp, Homo sapiens
  misc_feature 30, 31: n = A,T,C or G
ggccgcacgcctaaccgctaacattactgnnggccgcctactcatgcacctaattggaagcgccaccctagcaatatcaaccattaaccttccctctacacttatcatcttcacaattctaattctactgactatcctagaaatcgctgtcgccttaacccaagcctacgttttcacacttctagtaagcctctacctgcacgacaac

SEQ ID NO: 27478 - DNA, 452 bp, Homo sapiens
  misc_feature 5, 34, 59: n = A,T,C or G
gggcnatccctatggtgctaatgtgtctgtggtncctcgctctctgtctccaggcagtnctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaattt

SEQ ID NO: 27479 - DNA, 424 bp, Homo sapiens
  misc_feature 31, 57, 211, 398, 415: n = A,T,C or G
ggaggcggagaacactggagaacttgatttntgacacgaaatatgaagtatctgtanttcctgaatatttctcaggacctggtactccattaactggaaatgcagccactgaagaagttagagggaatccaagagacttaagagtttctgaccctacgacgtctactatgaaattatcttggagtggggcaccaggaaaagtgaaacagtntctcgtcacatataccccagtggcagggggtgaaactcaagaggtcactgtgaggggagatacaaccaatacggtgctgcagggattgaaggaagggacacaatacgccttatctgtgacagccttgtatgcgtctggggctggagacgccctctttggtgaaggaacaacacttgaagaacgtggntctcctcaagatttagntactaaaga

SEQ ID NO: 27480 - DNA, 338 bp, Homo sapiens
  misc_feature 3, 25: n = A,T,C or G
cgnggttcaccctcttttccccccntgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctgacttgattggtctggctgccgtcattgtcagcacagtgccatggacatgggaagacttgactgcacagccaatggttttcatgatga

SEQ ID NO: 27481 - DNA, 210 bp, Homo sapiens
  misc_feature 30: n = A,T,C or G
gggacccattcaaaatacaagtactggttnaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaagaatctaaacct

SEQ ID NO: 27482 - DNA, 307 bp, Homo sapiens
  misc_feature 25: n = A,T,C or G
ctgtaagtcagaacgaattttcttnactttctcatttgaccttaattcaaatgataaattttgcccacgtgtaaatgtgtgtgtgtgtgtgtgtgtttgtgtttgtttgtttcaggggccgttgacatttagggatgtggccatagaattctctctggaggagtggcaatgcctggacactgctcagcaggatttgtataggaaagtgatgttagagaactacagaaacctggtcttcttgggtgagaataactttaatacaaaatcccttatataccctaaagttttcatttctctgttttcatag

SEQ ID NO: 27483 - DNA, 358 bp, Homo sapiens
  misc_feature 6, 19, 56: n = A,T,C or G
cactanaacttgataagtnttgcactatttaaaaagttttagtaatatcatgaatntaatttgcttaagatttagtacatttcagaacttttgaacttttgacaaattgcattgggaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactg

SEQ ID NO: 27484 - DNA, 301 bp, Homo sapiens
  misc_feature 2, 26: n = A,T,C or G
gncggcttctggtactcctctctaantaccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacaac

SEQ ID NO: 27485 - DNA, 279 bp, Homo sapiens
  misc_feature 24, 257, 262: n = A,T,C or G
aaaacctgtccattttctacctgntaaccttcatcattttgtgccaggccctggaagcaaagagaggaagggaccgactgcatttatctttgaacacttgagcatcagtagtactactgagtggccaggggtcttgtctgtcaaagcaaatgataagttcactcaggccattattgactgctgaactctcttccttcccaactcttccttgaaagagaaaaaaatactttgccttcttgctctccttatcgaatgtnggtgnacaaatagtgtaagcct

SEQ ID NO: 27486 - DNA, 419 bp, Homo sapiens
  misc_feature 6, 7, 30, 31, 397: n = A,T,C or G
aacctnntggaagggaagacccctctgctnntgcggctctgtgaggtgacactgaggaagcctaaacaagactctggtggtgacaagctcagggatgtggctccgagtttgctccactcactttggacttcacatctgaatgatttggaagacctgtacaaacaggtgtgttcaacttcatggtgtatctaggccaaaatgtttcctacatgcacagagttcaggttttgccacagagctccccttttgtatgcaaatgttttccatcatgtgcctatggccactccttgttgagaccttgcatccttgccggtggcatactggagccccaaaagtagcctggggtcccaaaagatagttaggtcccttctgatacctgaatccatccttgtcttangaaaggggtcatcagcttccat

SEQ ID NO: 27487 - DNA, 245 bp, Homo sapiens
  misc_feature 6, 239, 240: n = A,T,C or G
aggagnaactatgagcctgaaaccttatataagaaaacatgtttaggcagaaaatattcaaaagactataaaacacatattaaagaaagttcctaaaaattgaaagagaacaaaatgcatttcctttcaaagtaacaatactattgctaacttctaaataaaagcaatgaaattcagaagatgatagaataatatcatctaaatgctaaaaggaaataactgccagtctataatacttnntccag

SEQ ID NO: 27488 - DNA, 267 bp, Homo sapiens
  misc_feature 24, 254, 255: n = A,T,C or G
aacacactgcgtgaagcttcatcngcgaaaatgcgtattgcctgatctccctgcatcccttctggcttttgtttcttctttcctctgaagattatgtaggtaccctgcccagtacccatacgtttagtgtttgtgaccaaaaggatttcgtataatgtatcaatagagaatgcttaatgtgtttgttttggataaaatatcccagcatcttaaattcattgtcagattatacataaaacgcttaattggctgtnntaaaacattaga

SEQ ID NO: 27489 - DNA, 131 bp, Homo sapiens
acccaaaagtgggtagccatctgtgaggctgagtccagggtttttatgggcttagaataggggaatgtgtgccatttcgtttatggttgggcttggaaaagataccatttgattggctaaaagacatcgtt

SEQ ID NO: 27490 - DNA, 230 bp, Homo sapiens
  misc_feature 19: n = A,T,C or G
gttgaattaactctgctgngaggccctgtgacttggacctcatctgcatataaagctgacaacgcctggctgccgctggctctgcggtccagaaactcacctcctctgtcttctttcatactgtttaacatctttccgctgctagagttgaatctgatggagagctttaccggattgggcttaaggacattcacctctctttcagttcacaggcaataatttatacttct

SEQ ID NO: 27491 - DNA, 210 bp, Homo sapiens
  misc_feature 32: n = A,T,C or G
ctctcaacttcgttttcttcaattataatatnaagcagctagtcttgattattattaaggtctcttttaatgcaaagaccccctaccagtacaataggtgcagtgtaggcccagctacttgggaggctgaggcaggagtattacttgagtccaggagttcaagtctagcctgggcaatatagtgaaaccctagtcttaaacatttttttc

SEQ ID NO: 27492 - DNA, 135 bp, Homo sapiens
  misc_feature 25: n = A,T,C or G
aataatgcctttgcatagaaaatcnaattcagggaccacaaagaattttcagtgggaatgtctagtctgaggggtctgaggttgtttttactttattgtgttgtttaaatattttaaaaatatctttagcgtttg

SEQ ID NO: 27493 - DNA, 334 bp, Homo sapiens
  misc_feature 31: n = A,T,C or G
cgaaccttttatgatgaggctagtcaagttnatactaaagttcatatggataaacaaacatgcaagaatagtgaggaatatacttaaaaagaaaattacaaatgcagggggtatgagaatagtcctaatagacattaaagcaaactataaagtctgtaattaaaactatggagtacagtaatggcaaatgaataaacagacaaggagaataaagtccataattaaacccaaatatgtgtggaagtttagtatataatgaagttagcatttcaaatcactagggcatagatagactttttaatatatggtatagccatatattaaattcaaatgc

SEQ ID NO: 27494 - DNA, 319 bp, Homo sapiens
  misc_feature 31: n = A,T,C or G
ggatcgcagccatcttaccttctatcagatnagcctcaccgtacccaggaagaaagaaggtgaaagaggaatgtgaaacaggtggctgggacccagaaaccctcttaccctgcacctctgtcatacttctcccggggcatagggagagttattctgcttctctttgccttgttttgtaacatggggtagttgttggtgcagccatgttgtgctgagtgaacatatattaagatctttggaacctttaggagactgaaaataggtaagtatgaattagtatttctggaatggtattcagagaacttcgtaccatttttat

SEQ ID NO: 27495 - DNA, 294 bp, Homo sapiens
atggagactgtctggaaggcttgcaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaatttttttaactcaaaatttgtcaatcatttttaatagttctttttttttataaaaagaaaaaggaatttaaggac

SEQ ID NO: 27496 - DNA, 395 bp, Homo sapiens
  misc_feature 25: n = A,T,C or G
atatgcgtgtatgtatatatgtatnctgaaataaaggacaactatacggggatagtataaaatgaactgaaaccttgctggagaatgtgatgtctttctttttaaatgtatgtttccaataactttcagcgatatttttgcactcagttcttgacattgcttatctagaattatttgattgtagtttccttatcctcatctcacttgtataataatctttatacaacaccatctcggccaagtggaagccatttctcattttgttgattttattcctacccattattcattattgctcatcagcccttaggttctcaatatagaagcaatactcaacaaagtgagggattaacaacagcattttaattctcatcttgatctgctattggttgtat

SEQ ID NO: 27497 - DNA, 147 bp, Homo sapiens
agcaaaaccatgagggaaaaaaacagcaaataagcaacaggggaaaacagctatgaaaaaaatatatttgtactgaatacacatacaaactacatcccacatgaaagattaatatcatcaagtaagaaaaatacatagtttaaacta

SEQ ID NO: 27498 - DNA, 130 bp, Homo sapiens
cgtcgatgaagaacgcagctagctgcgagaattaatgtgaattgcaggacacattgatcatcgacacttcgaacgcacttgcggccccgggttcctcccggggctacgcctgtctgagcgtcgcttgccc

SEQ ID NO: 27499 - DNA, 225 bp, Homo sapiens
cttctctttatggagaaatattgatgaaaacactaaatctctataaagaaaaaataaatcagtgaaattttgcagtaggatgggaaaagagaaagaaatgccaaagtgaaaattaacttcagaatacagtaagtcctcacttaatgtcatcagcaggttctttgaaactgcagctttaagcaaaatgacatataaccaaaccagttttacccttggctaaaattt

SEQ ID NO: 27500 - DNA, 406 bp, Homo sapiens
  misc_feature 24: n = A,T,C or G
aatcagaatgtggataggaacagncatcactgagattcaggagacagtgaaaacctaatccagggattctaaggattacaacaaagtgatacaggagatgaaagacgaaatggccactttaagaaagaacagaactgatctgatagagctgaaaaactcacttcaagaattccagaatacaatcacaaatataacggcagaatcgatcaagctgaggaaagaatctcagagcttgaatatcgcttctctgaaataactcagtcagacaaaaataaagaaaaaaagattaaagaagaatgaacaaaatctccaaagtatgggattatgtaaagacaccaaatctatgactcactgatgtccctgaaagagagggagagaaagcaagcaacttggagaacatatttca

SEQ ID NO: 27501 - DNA, 248 bp, Homo sapiens
ctgattgcctttgttccagacaaccttttcaaggatgtttgtgcagcaaacagctttccgaggttgaggaagtgttttgcctctgataaaagggcaggcatgcttattgaacgttgttaaagtttcaaagtttcctacgttcagagtttctcttctgtaatgcaacccaccaggtatacagctgtcaatcatctggccctcttggtgcttcatgggatagcaggctcaagaaatcataaaggaaattg

SEQ ID NO: 27502 - DNA, 148 bp, Homo sapiens
taacaccctgattcggcctgatggagagaagaaggcatatgttcgactgactcctgattacgatgctttggatgttgccaacaaaattgggatcatctaaactgagtccagctgcctaattctgaatatatatatatatatatctttt

SEQ ID NO: 27503 - DNA, 323 bp, Homo sapiens
cagtagatacctgttgattaaatgattgactagatcctacctcagaggaatacctttgaagatgtataaaatttctttgaaggctataaggtgccgaataaccttaggagggttcactgcttggccttagtagcgttcatgattttggattttgaattgtttctatgtaaccctgaaacactcagacttacttattgcattcagggtgtagttcatagcatcagcagttctgccaggtttgtaaggaacacacatctgttagagtgtgaaggccctggagtgcattggtgctcactataaccttgaactcctgggttcaggga

SEQ ID NO: 27504 - DNA, 168 bp, Homo sapiens
  misc_feature 26, 167, 168: n = A,T,C or G
gtaagcttcatgcacttaaagaagtntttttagaataagaatttgcatacttacctagtgaaacttttctagaattatttttcactctaagtcatgtatgtttctctttgattatttgcatgttatgtttaataagctactagcaaaataaaacatagcaaatggcnn

SEQ ID NO: 27505 - DNA, 306 bp, Homo sapiens
  misc_feature 2, 22, 301: n = A,T,C or G
tnaatccctacaacaacccagngcaattagttactgttactatatctgtagtgcagatgagggaactgaagcacagggacaataagcaacttgcttaggttcacacatcttgtctgtggtggagctaggacttgaactcaggcagcctggctctagaatacgtgctcctaacatgctgcttttcttgctttatcagggcaatgagaaaattagatgtgtaatatatctttcatcaagcaatataaaaacattctttgacatttatataatactatataattcattgagtaccagctgtgtnccaga

SEQ ID NO: 27506 - DNA, 118 bp, Homo sapiens
  misc_feature 25: n = A,T,C or G
aggggaaaaatgattgttgtatacnctgaatcgctttgcatggtctcatttgagataattgatgtaagaatcctgacttttttatatttggaaacatcaaataaaaatggaaaaaatg

SEQ ID NO: 27507 - DNA, 385 bp, Homo sapiens
  misc_feature 21: n = A,T,C or G
cttcatgaatcataattcagncttctagtttggggcacataaaaaaagccaaacattcagttggcctcttccatatctagctgatttgctttagtgattcatttttcattttcctcacaattagactcaaatttctgggctgactttctaattttgagtctctaaagttgtaaattctgtagccatagaacaaaaatgacatagaaacacaaggtaacacaattgtatctttgaatgaaaacatacatatgttgtcttgaccccgttaccattttacaactcttacataaagaaatcaccagatgtttaaaaaatagaacgctgatgaatcttttgttcttccctaacctttatgtttttctgctgcagttttatctcagtaaga

SEQ ID NO: 27508 - DNA, 329 bp, Homo sapiens
agcctgtgcaagaaagtcaaactgagcaataacgcgcagaactggggaatgcagagagcaaccaatgtcacctaccaagcccatcatgtcagcaggagcaagagaggtcaggtggtggggaccagaggtggctttcgtggttgcacagtttggctaacaggcttgtctggagcgggaaagactactgtgagcatggccttggaggagtacctggtttgtcatggtattccatgctacactctggatggtgacaatattcgtcaaggtctcaataaaaatcttggctttagtcctgaagacagagaagagaatgttcgacgcatcgcaga

SEQ ID NO: 27509 - DNA, 316 bp, Homo sapiens
aaggagtactggaaggacagcttcctgaaaaaggtgatactgagctgaggcttgaagatatattttaaccttaaaaatgaattcctcagggggaagaatggatgccttgaaacttgctctcaagtttttcatgtgtttctttttgtaacttaatgtctctactttgcatatgtccctttggcctttgcagtctctatgtctgtcattctttgcataataattcatatcaaaggggagaaacagctattttttgtccctagaagttctgctcttaaggttgaaaagaaagtttgaaaaatcatatcatttaggttag

SEQ ID NO: 27510 - DNA, 212 bp, Homo sapiens
  misc_feature 174, 176: n = A,T,C or G
actgtgaagatgaaattaccctaatagcatgaagatcgtgggtctgtgtgtccgtgaagtgagtcccgtctgccaggagctgacgaaccacgaatgcttctgcctgtgctgtgcattcccgggcccgcagctccggtcgaggggactccgatgtgaatttgttgtgaatttgtngngccacaatagcagttctggaatgaagctaggaaact

SEQ ID NO: 27511 - DNA, 120 bp, Homo sapiens
acttactgctatacttgtgatactgggtagcccagactttgaaggtgctttgtgaggtttggactcatgctgagaaacccacaggaaagcactgtccaggtaggattagaggcttcccac

SEQ ID NO: 27512 - DNA, 275 bp, Homo sapiens
  misc_feature 25: n = A,T,C or G
ctcatcgatgtgctgtctctggagngataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttct

SEQ ID NO: 27513 - DNA, 135 bp, Homo sapiens
  misc_feature 1, 67, 69, 80, 81, 96, 109: n = A,T,C or G
nctgcaggaagccaaagctccaagcacgcagcactgtagtacatttttgcctttgcccttgaaatgntngcaaaatactnngttaacaaaagctgnatagagagaacangcagcgtgcgtttagttaagcacagc

SEQ ID NO: 27514 - DNA, 239 bp, Homo sapiens
gggagaccgaggcgtgtggatcacctgaggtcaggagttcaagaccagccttgccaacatggtgaaaccccatttctactaaaaatataaaaaattagccaggtgtggtggcgcgtggctgtaatcccagctactcagaggctgagataggagaatcgcttgaacaggaggcggaagttgccatgagccaagatggtgccactgcacaccagcctgagcaacaagagtgaaactatctc

SEQ ID NO: 27515 - DNA, 122 bp, Homo sapiens
  misc_feature 7: n = A,T,C or G
gttgccnccttttccttttctctctctgattgttttaattgttctgtggtggttttaatggatttgagaccctggagcggcagctgcctttctgatttccagctgctttttgtgaataattt

SEQ ID NO: 27516 - DNA, 272 bp, Homo sapiens
  misc_feature 24: n = A,T,C or G
atttttaatcagtaaggcctatcnatattagttgccttttatttcttctccttgtggacagttgttaatgaaaggagtaaggatttccctttttttgttttgtttgttttgttttttttaaccaaattcttagagatactatagaatccaaatgagaactgaattggacctcaagtcttctattcctactaatagagttctttgtgatggtaactgctgtgtcgtttgttttccacaagttgggatggattcatgtcgatacatccccatgc

SEQ ID NO: 27517 - DNA, 287 bp, Homo sapiens
  misc_feature 25, 26: n = A,T,C or G
caggaaatactggcccgagggctgnnctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatg

SEQ ID NO: 27518 - DNA, 241 bp, Homo sapiens
tgggaggctgaagcaggtggatcatgaggtcaggagttcaaggccagcctgaccaagatggtgaaaccccttctctactaaaaatgcaaaaatttgctgagcatggtggcacgcgcctgtatcccagctactcaggaggctgaggcaggagaatcgcttgaacctgggaggcagagattgcagtgagccaagatcgcaccactgcactccagcgtgggcaacagagcgagactcagtctca

SEQ ID NO: 27519 - DNA, 318 bp, Homo sapiens
acgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgccccgcagattgataagtaatgaaagtgcactgcagtgagggtcaaaggagagtcaacatatgtgattgttccataataaatttctggtgtgatact

SEQ ID NO: 27520 - DNA, 426 bp, Homo sapiens
  misc_feature 5, 32, 55: n = A,T,C or G
ggcgnccggcgtgagttggactgtgaagattntggcggccgcgacgttgacttcnaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcagga

SEQ ID NO: 27521 - DNA, 348 bp, Homo sapiens
  misc_feature 25: n = A,T,C or G
tcactgccatcccaccaaacacacntatggacttgagaataattaggctttcagaaaccactttagtatccaattaattgtagttttcttcagaaagtggtgtaaatctgattatatatagttgcttcatgtagtataaatctgattatacacagttgtttcatatagtatatatctgatgatatacaattgcttcatgtagttcaacttgttactagataatccatgtgtaattgtcacagaaaatcttacgtgtacatttggacaatgtctctatctctgtttctttctctctgtttctctctctctctctcacacacacacacacagtcctttacaattactttg

SEQ ID NO: 27522 - DNA, 277 bp, Homo sapiens
  misc_feature 24: n = A,T,C or G
catagtgaagtatttactgccgcngagtataactgcagattgttctcaaatgcttcaggaaaaaaatgtgtgagggtatgtttgatattctttgtgtgaatttataactttttagtaatttgaatttatttcaaaatgacaagtaatatgtgtctgtttatctcacagttggcttcttaccatacagccacattgtttgtttacatactgactatggctgcttcacataaaatggcaaaattgagtagttgttacagaggtcttatggcctgcaaag

SEQ ID NO: 27523 - DNA, 247 bp, Homo sapiens
atatacccctaaaaggttcttggggaggacccaaggattctcttaccaaattttgagaaccactttctttaaagtaactcatctactctctgtatctttaccttcagtcttctctaaggaggagttctgaatttcctacagataacttggagaaggaagtaagcacttttgttattttgaagttagtgactgtgtcctgatagtagtgtataaggtaacactataaagaaaaacaagaaaagagttt

SEQ ID NO: 27524 - DNA, 342 bp, Homo sapiens
gctggtgccctttctggtaactgcaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccacgtaaatcaagccattcattttggggaacagaagatccataactttagaaatacgggttttgacttaactcacaagaga

SEQ ID NO: 27525 - DNA, 417 bp, Homo sapiens
  misc_feature 25: n = A,T,C or G
tagctactgaagtcctaaagagcangcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagact

SEQ ID NO: 27526 - DNA, 322 bp, Homo sapiens
  misc_feature 21, 23: n = A,T,C or G
gaaaactattgtaaagtagtncnatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaaga

SEQ ID NO: 27527 - DNA, 266 bp, Homo sapiens
  misc_feature 155: n = A,T,C or G
tatggagatgacaatctggctcccaacactgccaacgtccagatgaccttcctacgcctgctgtccacggaaggctcccagaacatcacctacctggagaaaaaacagcattgcctatctggacgaagcagctggcaacctcaagaaggccctgntcatccagggctccaatgacgtggagatccgggcagagggcaatagcaggttcacgtacactgccctgaaggatggctgcacgaaacataccggtaagtggggcaagactg

SEQ ID NO: 27528 - DNA, 341 bp, Homo sapiens
gtagtcaatgtaaagtgttactgcaaatatgaggtgatattgctatcccccttcagtctcctaatgagggaaaatttgaaaagttaacattttttacatctaaagtgtatctggtgatttacaaagaagatattcaagttactatgaaatgcttatttttatttatcaaaaatacatttgaattatctctgtaaaagtaatcattagatcaggtttgcagtagtggaggggataatattaagtgtaccattagaaagccttccattcaaaagacaatggaacatgcatggtgcaggaagtgggcagggctccttggagagcatatggtgagggcatcattt

SEQ ID NO: 27529 - DNA, 318 bp, Homo sapiens
aaggagctactgagcttttgactaggggacagaggaaaatgttgatagaagatgagctttagcaacagtaggtaaagatgatttgggaagaaccaaggtaagactagatagctggtcttctatggttgcctccatgattaagctggtgttagtgctaaaacaaacaaacgtgagaaatttgagattaattcagaggaagaatgaacaaaattttggtgctaacttgatatggttagtgaacagaaaagaatgactaaaagatgactccacggttttgagcccaagtgatgggaatgattgttccattgccagcgaaga

SEQ ID NO: 27530 - DNA, 284 bp, Homo sapiens
aagggccattttatgatagttttccaggtaaatgaagagttgtgtgatgattcttgacaggaaggatataagagagaatatgtatatttatttatttattttttatttattttgcaacggagtctcgctctgttgcccaggctggagtgcaggggccctatctcggctcactgcaacctctgcctcctgggttcaagtgattcttctgcctcagcctcctgagtagctgggatcgcaggtacacgccaccatgcctagctaatttttcgtatttttattggaga

SEQ ID NO: 27531 - DNA, 426 bp, Homo sapiens
  misc_feature 17, 21, 173, 176, 177, 371, 403, 405, 417: n = A,T,C or G
cacggcccagcttcctnaaanccgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgnggnngaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttncatgaaggggctgggaaccgacgaggactctntnatggagatcatncgctccaga

SEQ ID NO: 27532 - DNA, 225 bp, Homo sapiens
  misc_feature 2, 5, 131, 158, 224: n = A,T,C or G
cnccncagttacatcctcaacacaaactcctcaccaggtggcagaagtggaagaagctgagatgtggctgtgagtcctgacttcactgctgtccagcggaaagagtctgagcagtctaaacccgaggtttngccagtgtgaaatggggctaattatanagacatatgggttttacaaagttttgacaaatcagaacttttgttttatatgctgggttgaaatcna

SEQ ID NO: 27533 - DNA, 255 bp, Homo sapiens
  misc_feature 27, 179, 181: n = A,T,C or G
aggctgggcaagtaatgtccattcccntctacttctattcaatattgtactggaagtcctaaccagcgcaataaggtcataaaaataaataaatgatatttacattggaaaaaaatgggcttgcactgtctttatttgcagatggtaagattgtgtgcatagaaaatcctaaagaaccnanaaatacactattaaaataataagtgaatttaacaaagtttcataatacaaaaacaatgtacaataatagttctg

SEQ ID NO: 27534 - DNA, 320 bp, Homo sapiens
  misc_feature 24: n = A,T,C or G
tctgtcaccaccacattccctgtncccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaaga

SEQ ID NO: 27535 - DNA, 344 bp, Homo sapiens
atcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgatac

SEQ ID NO: 27536 - DNA, 330 bp, Homo sapiens
aatactacacactccctttctccctctggagatcaacccacattagagtgtctaaggactcctgaggattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggg

SEQ ID NO: 27537 - DNA, 100 bp, Homo sapiens
agcagaaatagactgggaagatgcacaaccaaggggttacaggcatcgcccatgctcctcacctgtattttgtaatcagaaataaattgcttttaaagac

SEQ ID NO: 27538 - DNA, 431 bp, Homo sapiens
gtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagta

SEQ ID NO: 27539 - DNA, 365 bp, Homo sapiens
  misc_feature 17, 21: n = A,T,C or G
aagagaactttgccgtngaanctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattg

SEQ ID NO: 27540 - DNA, 356 bp, Homo sapiens
tggaattaacagtaagaaggacaaagggattgaatggacttacaggaaggatttcaagtaaattcagggaaacacatttacttgaatagtacaacctagagtattattttacactaagacgacacaaaagatgttaaagttatcaccaagctgccggacagatatatattccaacaccaaggtgcagatcagcatagatctgtgattcagaaatcaggatttgttttggaaagagctcaagggttgagaagaactcaaaagcaagtgaagattactttgggaactacagtttatcagaagatcaacttttgctaattcaaataccaaaggcctgattatcataaattcatatagga

SEQ ID NO: 27541 - DNA, 215 bp, Homo sapiens
  misc_feature 213: n = A,T,C or G
atgtggtccctggtcatgacataacctagcagcagtaggaaaaactcccttctatgaaggggaagcagactgggccataaggaaacagcaggactggctcaagtgcccaaggtttgtttagggcctgggaattggccatgtgttaatttattgagtggagtaggtggctttttttccctccctcttcccccaacaagaataaagtttattaantc

SEQ ID NO: 27542 - DNA, 164 bp, Homo sapiens
  misc_feature 26: n = A,T,C or G
tcggggcatgtcgagtaaagctaccnttgccagtcctgggtgggggcaaatcctcgagcttgatgtgtggggaagggaaggggcctgaataatccttgaggagtagtagaatagcagatggaacactgagaagttatttccttgaggatagatttctacgatga

SEQ ID NO: 27543 - DNA, 334 bp, Homo sapiens
  misc_feature 30: n = A,T,C or G
attgctcaacattttgacatactaaccagnacatctttcatacttaagattccattccataatactgagtaggagaaaatgcagtcgcatatttaactgatgttgagattttggcctacaggaaccttagcaagactattacagtcaaaaacacttaagcagatgaaatacagtcatatctcttgtcctcttaaaaagaatagttagattttctaatgttaataaagacatttccagtgatccttaaataaaaaatatgctctttatgtaacccattagctctctctggttgatttacaactttattctcaataatacagtagtatattgatat

SEQ ID NO: 27544 - DNA, 299 bp, Homo sapiens
  misc_feature 1: n = A,T,C or G
naacgttatgatgagtatatacttcgtaccggtacagcactaagaaatttccaaacattacttaatttaatcattgcaggattcctaagaggtagacgctattttatccctcttgtacagacaaggaacaaggcttaaaaagatgaggtaagctggtcatgttggatcactcctgtaattccagtgcttgtctgggaagccaaggcaggaggatcaattgagcccaggaggttgaggctgcagtgagccgagatcacaccattgcacaccagcctggacaacagagcaagaccctttcg

SEQ ID NO: 27545 - DNA, 317 bp, Homo sapiens
  misc_feature 16: n = A,T,C or G
agataaaattaatttntgtgtatatggtggaaatttgtggctagtgtgatttttgtttgtttccttttaagtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtac

SEQ ID NO: 27546 - DNA, 123 bp, Homo sapiens
ctgaatagtcttaattacgtttactaaattctaaaggatttctgtgctattataattaggaaatcaacgtctttggtcaggaactttataatgtgctattaaatgtatattacatttttgtgg

SEQ ID NO: 27547 - DNA, 298 bp, Homo sapiens
  misc_feature 58, 68, 69, 83: n = A,T,C or G
agggatattattgaatacccaaataaaacgaactgatacatatttctccaaaaccttnacaagaagtnnactgttttctttantaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttt

SEQ ID NO: 27548 - DNA, 446 bp, Homo sapiens
gacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaatttttgatgtga

SEQ ID NO: 27549 - DNA, 500 bp, Homo sapiens
  misc_feature 2, 19, 36, 37, 61, 75, 76, 99: n = A,T,C or G
tntgggcccgggaagggcnccttgtgcctgtaatcnntgttgatgtcccttcacgttgccnaatgcatttttccnnttcctgttaaggctccctcagancttcttgtcccttcctctcaaaacaccagatcctgtagcctttttccagacagcctttacctatttccttacccctcagtattaagaaatttttcatgtaagatgttctcagaatcttacaagtatccttgtacccatttctttttgaagaacatgacctttattgagcagaaattttttcctacttgcattttttcagactttaaccactattgtctttttagaaatgtacagaaatgaaagatgggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaata

SEQ ID NO: 27550 - DNA, 146 bp, Homo sapiens
gtcctgctgttgttctctgtcctccgtgatagaaaattgagatttactttgtagcaaaattgagccaatgagacactggctcacaaagagataagaacattagaacatcaatccaaaatgttcaacagtcaactaataggcatttt

SEQ ID NO: 27551 - DNA, 288 bp, Homo sapiens
aagcacaccctgatcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggac

SEQ ID NO: 27552 - DNA, 284 bp, Homo sapiens
tatggccggggatgtgctactgtaaatatacctctttaattacttctggtctctttggtgacctgtttaaatttgtgtacattattgtacatagaataaaatgttttcacatttttatgacaaaatttgaacaaatagctttttaatagatgtaatgatcatatggtgcgtcacctgtgccaaatattcttcaatgaaattatataatgtaactttggacctcagtttttctttagaaatgggtgggagaatgaaaatgcaaatcaggaaaccacattaaagtc

SEQ ID NO: 27553 - DNA, 407 bp, Homo sapiens
  misc_feature 19: n = A,T,C or G
ggctgcgtctactgcgagnaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgaga

SEQ ID NO: 27554 - DNA, 392 bp, Homo sapiens
gaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaaga

SEQ ID NO: 27555 - DNA, 163 bp, Homo sapiens
  misc_feature 12, 26: n = A,T,C or G
tatggccgggancttaagagtgaccnggaagaggttcattgaaataatcatgccatgaagcgcccaaagatgcacccatgtagaattttcactttgtactggcaggctcgttttacctcattctagaatatttaagaatctaaaaataaagggcaactctgat

SEQ ID NO: 27556 - DNA, 244 bp, Homo sapiens
  misc_feature 12, 16, 34: n = A,T,C or G
tgcttgagctcnagantttgagatcagcctgganacatggcaaaaccccctgggcaaaggggcaaaaccccctctctaccaaaaatacaaaaattggccatacatggcagcacaggccctattggtcccagctacttggtaggctgaggcaggaggatggctgtagtccgggaagtagaggctgcagttagctgtgattgcaccactgcactcttgcttgggtgacagagcaagactctgtccc

SEQ ID NO: 27557 - DNA, 102 bp, Homo sapiens
ggaactgtgtgtgtcctacacaatggtgctattctgtgtcaaacacctctgtattttttaaaacatcaattgatattaaaaatgaaaagattattggaaagt

SEQ ID NO: 27558 - DNA, 109 bp, Homo sapiens
  misc_feature 9: n = A,T,C or G
ggggaaatnagggttcgattccggaaaggagcctgagaaacggctaccacatccaaggaaggcagcaggcgcgcaaattacccactcccgacccggggaggtagtgacg

SEQ ID NO: 27559 - DNA, 130 bp, Homo sapiens
  misc_feature 5: n = A,T,C or G
cagancagggaggaggctgacattgccagtctcttctggggcccaaggcaggttgcaggagatccaatcccatagacagctctgggcctcttgcatttgagtttttcagaattaaactgcagtattttgg

SEQ ID NO: 27560 - DNA, 125 bp, Homo sapiens
  misc_feature 16, 20: n = A,T,C or G
gagacggacggtggcngggnatcaggcagcggctcaggcgaccctgagtgtgccctcacccctcactggtccactggcttgagactcaccccgtctgcccagtaaaagcctttctgcagcagctg

SEQ ID NO: 27561 - DNA, 326 bp, Homo sapiens
  misc_feature 8: n = A,T,C or G
ctccaaantgctgggattacaggtgtgagccccacggccggcctatacaaagtttcttattgagaaaagtggttccaatcatgttttttgccccctttagctgctatctcttgaacagaaaagtttgttaggaaggtaaaagttgctgactaggaccttacccacagggtggcactctgtccttgggaaatataaatgcaagtaaaacaggtttgaacttcttaacttccagaagataggaggatgggacctgtgatactgtgctgctggtgggaggacccttccacatcaacatttgtgtgtatccttgcaataaacttccattg

SEQ ID NO: 27562 - DNA, 165 bp, Homo sapiens
gagttttactcttgttgcccaggctggagtgtaatgatgtgatctcagctcaacgcaacctccgccttccaggagaatctcttgaagcagggaggtggaggttgcagtgagccaagatcgcgccattgcaccccagcctgggcaacaagagcaaaactccatctc

SEQ ID NO: 27563 - DNA, 274 bp, Homo sapiens
cgcagtggctcatgcctgtaatcccagcactttgggaggccgaggcgggcagatcacatgaggtcaggagttcgagaccagcctggccaacatggtgaaaccccgtctctaccaaaatacaaaaattagctgggcatggtggcatgcgcctgtagtcccagcgactcgggaggctgaggcatgagaattgtttgaatccaagaggtggaaggtgcagtgagctgaggtcacgcaactgcactccagcatgggtgacagggcaagactctgtctc

SEQ ID NO: 27564 - DNA, 360 bp, Homo sapiens
  misc_feature 23: n = A,T,C or G
aaaccaagaaggaactcttgatnaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagat

SEQ ID NO: 27565 - DNA, 284 bp, Homo sapiens
  misc_feature 283: n = A,T,C or G
atttgatggttgatgcaatattttaacacttgctgatgtgattctcaatatgaataggagaaatatttaaggcagctggattataaatggtaaagggacatataggaaggtaaagttgctacccttcactcacaataaaatgttgataatgatagactgtgacaaattatgtttatattgtaaatacattgaactaccaataaaaattatatatgaagacatgcaattgaaaatactatagacaaaaatgatatccaagtaaataatatccaagtaacccgtng

SEQ ID NO: 27566 - DNA, 372 bp, Homo sapiens
  misc_feature 12: n = A,T,C or G
tgttggaagaangtaaaataaggacttcgttgtataaaaagcattatctggcagcccttatagctatatgggaaatgcctcaaagagatgcatcctagtgaagatgaggaacatttggacaatttgagtgttctctttcagttggataattttcagttggatatctagcaaaacttagtcctcatttttttttgtttgtttttcctctgatatgcaatgtagactacatcaggcctttatagtcaaaaccagaccaaccagttttgaccaagcacttcctctcttcaaggctatgtttagtgcatcaggaatcgaaagacatctaagacataaaccctatccccagagagtatactatctgttaggggaaga

SEQ ID NO: 27567 - DNA, 155 bp, Homo sapiens
  misc_feature 2: n = A,T,C or G
tncccagggaaattcggcattatggccggaggctgagaactcgttccctccagcatttcatgaaaaagctgcttcttattaatcatacaaactctcaccatgatgtgaagagtttcacaaatccttcaaaataaaaagtaatgacttagaaactg

SEQ ID NO: 27568 - DNA, 471 bp, Homo sapiens
ggaaaaccgctgattgcttattctcctactggggagtaaatagataatgcctaaaactgaaatatcacataatacagtcatgctattatggacatggaggtaaagactcccttctcataaataaagagcttagagtgattatctctaggaaggaagaaatggaagggggagatgggagagtagttcttcataacaaatttataaaattatttgacattttaagccacgtgaaagtataaatttaataaaaataaggaccaaagccaatttttaaagtctgtttaaagagcagactagatataaatgtgggaaaaaaatctcttgaacttgaagatagtgctgatgaaatcaactagcatacagccaggacttagaggttcagattaaaggaaaattctaggccgggtgcgctggctcatgcctgtaatcccagcactttgtggaggctgaggtgagcccaagagttcaaga

SEQ ID NO: 27569 - DNA, 152 bp, Homo sapiens
ggagcttcatggtgaaggcagtagttctggaaaagccctggggacgagacaggtgctaaagttgaacgagctgatggatatgaaccaccagtccaagaatctgtttaaagttcagacttcaaatagtggcaaataaaaagtgctatttgtgg

SEQ ID NO: 27570 - DNA, 308 bp, Homo sapiens
  misc_feature 1: n = A,T,C or G
natccccatggaagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatga

SEQ ID NO: 27571 - DNA, 347 bp, Homo sapiens
gctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagaagaagacagctgaggatgccaaggacttcttcaagaggaaga

SEQ ID NO: 27572 - DNA, 273 bp, Homo sapiens
  misc_feature 249, 258, 272: n = A,T,C or G
gggaagcttgggggtctaaagaaatcagaaaggggagaaaataatcctgcgtgtgctcagccctcactcagatcaacagcccctcgggtcccagctagatgtactttgtagaaggctttttttctccccctcaccctcaaaactccagggttaatgtgctattcccttttttctactgttctctgtctccccccaacccatcagcagtctgagaaatgctatggtggaaaaaaaaaaacaacagccctntaaccagtncaaacaaaaagccng

SEQ ID NO: 27573 - DNA, 401 bp, Homo sapiens
  misc_feature 1, 16: n = A,T,C or G
naactgtttattggtnagcttttgtctataccaaaaaaagtatgtgtttattgagtaattaagttgtactttaccattaatacaatttaaaaaatgccttgacccttccaatacggattcctcatctgtttacccatttttgcaatagcttgaacccctgccccctccctcaatcgactaacacaaatggaaaatgataaagagcaggcagaggaaggaggaggagaaaagtgaagagaggaaggctttcaagacacttcctgtactacatgccactgaagttcaagtaatagttgtaataataaccaaaatatagatttaaaagtgaacattggtgtatggttttagaatttcacgattttgataggtcatttaatacttccagtattttgagtgtcaga

SEQ ID NO: 27574 - DNA, 237 bp, Homo sapiens
  misc_feature 237: n = A,T,C or G
agggcatgattaacaaagcaacctttcccttcccccgagtgattttgcgaaacccccttttcccttcagcttgcttagatgttccaaatttagaaagcttaaggcggcctacagaaaaaggaaaaaagaccacaaaagttccctctcactttcagtaaaaataaataaaacagcagcagcaaacaaataaaatgaaataaaagaaacaaatgaaataaatattgtgttgtgcagcan

SEQ ID NO: 27575 - DNA, 282 bp, Homo sapiens
  misc_feature 282: n = A,T,C or G
cgtggtggctcatgcctgtaatcccagcactttgggaggccgaggtgggtgggtcacttgaggtcaggagtttcagatcagtctggccaacatggtgaaaccccgtctttaccaaaaatacaaaaattagctgggcacggtggcgggcacctgtaatcccagctgctcaggaggccgaggcaggagaatcacttgaacccgggaggcggaggctgtagtgagccgaggttgtgcctctgcactccagcctgggaaacagagcaagactctgtcccccccccn

SEQ ID NO: 27576 - DNA, 395 bp, Homo sapiens
  misc_feature 8, 17, 21: n = A,T,C or G
tgctcagnatacaaaanaagnagagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatgcagaaggcaagattccaccggatgctacattgatttttgagattgaactttatgctgtgaccaaaggaccacggagcattgagacat

SEQ ID NO: 27577 - DNA, 321 bp, Homo sapiens
ggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatat

SEQ ID NO: 27578 - DNA, 185 bp, Homo sapiens
  misc_feature 24: n = A,T,C or G
aactatcttgcttcggtacaaagnaagacaatattaactatattgaatattaaatacatatgggaaacccaccgtgtgtttacccatgaggacagggagaaaaagtataatttgagatttttttttaagtagaataataaggacttgagtaatgcacaaaaaatgtgtatttatagtataaatct

SEQ ID NO: 27579 - DNA, 177 bp, Homo sapiens
catcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaac

SEQ ID NO: 27580 - DNA, 206 bp, Homo sapiens
cttgcaactcggcgcatcccatgtaatgtattccacgcattgcagttacattatagtgttaagcacgcaggttgccagattttgagctctgttctatacagaatgttttgaggattttacatgacatcgccagggtccctcccctccatttctttttaaatcatgtctcctggtaattgtatgggaagaattatagatttctgagc

SEQ ID NO: 27581 - DNA, 424 bp, Homo sapiens
gggtgtttatccgtcactcgccgagttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggtttttggagagcaccccttttaccactgcctggttgcagaagtgccgaaagagcactggactccggaaggacacagcattgttggttttgccatgtactattttacctatgacccgtggattggcaagttattgtat

SEQ ID NO: 27582 - DNA, 404 bp, Homo sapiens
ggaagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctcctcagggttcagtcctcaaggggccatcctgtcccaccatgcagtgcccctagcttagagcctccctcaattccccctg

SEQ ID NO: 27583 - DNA, 360 bp, Homo sapiens
aaggtcccatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcaga

SEQ ID NO: 27584 - DNA, 289 bp, Homo sapiens; identical to SEQ ID NO: 26473

SEQ ID NO: 27585 - DNA, 178 bp, Homo sapiens
  misc_feature 11: n = A,T,C or G
gtagcgtggtnggtctgctgtaacatttcccaccaactctcttgctgtccacatcaacagctaaatcatttattcatatggatctctaccatccccatgccctgcccaggtccagttccatttctctcattcacaagatgctttgaaggttctgattttcaactgatcaaactaatgc

SEQ ID NO: 27586 - DNA, 341 bp, Homo sapiens
  misc_feature 11: n = A,T,C or G
gaaggctcagnagcgaccgtggccgggcggaagcggctttctggcctaagctttaacaggcttcgcctgtgcttcctgtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagag

SEQ ID NO: 27587 - DNA, 403 bp, Homo sapiens
ggatgaagaatagtgagaagactacttctggttgttgatcacagaaggttcctacaaagaactgacaggtcagctgagacttaggaaaggagaaggggccattaatgtaaaagttagtaggtatgggtaaggtctgtgatgtgttattaggcaaagaaagacaaggtcagagaaaagtataaatgaaaaggacaagaaaattatgtttttatcaccattagcagtacaactagagtggagtgattgggtgagaaataatagatcagctgagaaaaggatgctaagcttcaggtatgacaaagagaggcccatgcagtgttttctaaccttgcactctctttggtatatctgtcctccttcctggcccgttcctggctctgatggtcaccaagtgtactggaat

SEQ ID NO: 27588 - DNA, 296 bp, Homo sapiens
  misc_feature 1, 131, 152, 153, 236: n = A,T,C or G
nattgtaaaagcctaaagatctggacaagtttccaacaaccttgtttccatgagtatataattttggcagacacctgaattctttgggacactgtgtctgtgtatgtgtgtgtgtgtgtgtgtgtgtgtgngcgcttgtatcttgaagttgnngcacttcaaaaccacagctgctgtaaattcttaaacactggagagccatcctttggtttaaatggtagagggttagtggaagngcacacgttgtttttagcccaggggtagtaacaaactcttactagccaactagaaaatta

SEQ ID NO: 27589 - DNA, 463 bp, Homo sapiens
cagggcaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttg

SEQ ID NO: 27590 - DNA, 313 bp, Homo sapiens
  misc_feature 16: n = A,T,C or G
attctaaaattgtgcngcgagcaccgtgaacgactgcaatgcaagcgggtcttgctggctaaaatgccaggtaaagggttggttggacacagcgcttagtgcacgctgtcatcatggacatcataatcagttgtgaaaaacacgcgaacctatgacacttcttattccacactgaatgtgaaattgcatgttcagatgtttactacgaggcctggctcacaggaagtgttcagtaaaagtatgcactgttagattactgataacgcggatagatttttgtttaccataaattgttccagatttatattaatgg

SEQ ID NO: 27591 - DNA, 469 bp, Homo sapiens
  misc_feature 1: n = A,T,C or G
naatagcaaaaatgaaaattggaagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaagcacgtgtttgctgtgcttgcaccccaggtaaacctgcattgtagcaatttgtaaggatattcagatggagcactgtcacttagacattctctgggggattttctgcttgtctttcttgagctttttggaaggataattctgataaggcactcaagaaacgtacaaccacagtgctttcttcaaatcatatgagaaatactatgcatagcaaggagatgcagagccgccaggaaaattctgagttccagcacaattttcttt

SEQ ID NO: 27592 - DNA, 343 bp, Homo sapiens
ggagccggaagtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaat

SEQ ID NO: 27593 - DNA, 160 bp, Homo sapiens
tgtgtggaatattctctacataaattttatatgcacagtaatttccctttttatatgtcaagtaactatttgtaaaagttatactcacaaattattataatgattactaatatattttttccatgtttcattgcctgaataaaaactgtttaccactgtt

SEQ ID NO: 27594 - DNA, 396 bp, Homo sapiens
  misc_feature 1: n = A,T,C or G
natttctgataaggaaaagaacaaaacatatttctttgtagaggacaaatactggagatttgatgagaagagaaattccatggagccaggctttcccaagcaaatagctgaagactttccagggattgactcaaagattgatgctgtttttgaagaatttgggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagc

SEQ ID NO: 27595 - DNA, 160 bp, Homo sapiens
  misc_feature 1, 14, 24: n = A,T,C or G
naagttttaaaagncgttcaaagnaaagacacattacctttaaagaaatgaaaataatccaaagagctgacttaacaatagaaataatggaatctggaagacaaagataacattttcaaagtgttggtatcaagtaaaagccaaacaagttttataccca

SEQ ID NO: 27596 - DNA, 357 bp, Homo sapiens
  misc_feature 4: n = A,T,C or G
aagnactaaaccaagtattgtaaaataaacagcgataacagtgatagtttttaactctatggtcattgtatcactctggaaaatgtggagtagctgtaataaatctactcctgtattatgctttacagtgcaggtcttagtttttcttttttctcatttcttttgaaatggcatctcgaacaaagtccaccaatccctttacaaaagaatgaactgctcctctgtgtgtacttcatagaaggtggaatcggacagaggcaggttagtgacagttattcctgaaatacaggagcagagtacagtctgttgtggtttcccggattccgcgcctagctcagccaattaagcatgagacat

SEQ ID NO: 27597 - DNA, 370 bp, Homo sapiens
  misc_feature 2: n = A,T,C or G
gnaattatactattggcgaggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtat

SEQ ID NO: 27598 - DNA, 344 bp, Homo sapiens
  misc_feature 1, 11: n = A,T,C or G
nagaagcgagnatgacgaaggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttac

SEQ ID NO: 27599 - DNA, 422 bp, Homo sapiens
ggctgagtagcagcagtagactggccaactgcaaagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaaggtagtattttcctattttattttattctgctatgtattttttgagttgtatcaagccatataactttgccagtacttggcatcttttagtaacatgctgcaaagtgtgtagagtccgttgtacatatggttcctccctaagaacagaaaaaattaaatattatactgctcttttactgacattttgcccaacttatctttttcacttgattgttg

SEQ ID NO: 27600 - DNA, 427 bp, Homo sapiens
  misc_feature 9: n = A,T,C or G
tacagcagnaattaaatcccgttatttacaacaacatggatggaattgagggtcattatgttaagtaaaatatgccaggcacagaaagacaagtatcatttgttctcactcacatggggtagctacaaaaatttatcttatggaggcagaaagtagaatgatagttaccagatactaggaaggatgtggagggtgtggaccaaaagaggttggttagtcagcacaaatattcattcagacagaaggaataaattttattgtctgatatcacagtgtggtgactataattaacaacaatatattgtatatttcaaaagagctagaagagaaaatttgaaatgtttctagcacaaagaaataatacatgtttaaggtgatggatatcctaaataactcaatttgatcattacacattgtattcatgtat

SEQ ID NO: 27601 - DNA, 258 bp, Homo sapiens
agaagtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaaga

SEQ ID NO: 27602 - DNA, 299 bp, Homo sapiens
ctcaatgagtttgttttcaaaggctttgcactggagaagatatgtgtagaatttttgttttatttttaaaatgtgtaaaacatcttttgttttatatgcttttaagaatgtagattgtaatttaggaaatggcatatattctgcaaagtggtataatgttgtatatatgaaaaacaggtatatttggtttagttctgtgtttcagtgactgataaacaaaaatgaagctaaaatgaatcaacggctcattcatagttactaaagccatgtcatgactgtcattctattatgaagaaaac

SEQ ID NO: 27603 - DNA, 416 bp, Homo sapiens
  misc_feature 2: n = A,T,C or G
gnaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttagggaatgacttatac

SEQ ID NO: 27604 - DNA, 239 bp, Homo sapiens
  misc_feature 131, 148, 152, 182, 235, 239: n = A,T,C or G
ggcttacagtgcaccaagtatggccgcccccgtggatctagagctgaagaaggccttcacagagcttcaagccaaagttattgacactcaacagaaggtgaagctcgcagacatacagattgaacagctanaacagaacgaaaaagcntgcncatcttacagatacagagatcatgactttngtagatgagacttacatgtttgaaggtgtaggaagaatgtttattcctcagtnccan

SEQ ID NO: 27605 - DNA, 386 bp, Homo sapiens
  misc_feature 1: n = A,T,C or G
natgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttggg

SEQ ID NO: 27606 - DNA, 286 bp, Homo sapiens
aagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttagggttaagtaagactcgaga

SEQ ID NO: 27607 - DNA, 109 bp, Homo sapiens
gggaggctgaggtgggaggatcacttcagcccagaagcttgaggctgtagttagctattatcatgctattgcattccagcctaggcaacagagcaagaaccctgtgtct

SEQ ID NO: 27608 - DNA, 162 bp, Homo sapiens
gtctgcagctcacacataggcatgaccagcatagagatagagaggccccagtgctgctgagtaactgtgattccccaggtgatggcatcagctgagaagggaaggaagcccatgtgaggacactgaagaaggagtgagcagacaataagaagcccacagaag

SEQ ID NO: 27609 - DNA, 486 bp, Homo sapiens
  misc_feature 10, 19: n = A,T,C or G
ctcccagggnaattcggcnttacggccggggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaaga

SEQ ID NO: 27610 - DNA, 142 bp, Homo sapiens
gatggcgggtgcttgtagtcccggctgctcggaaggctgaggcgggagaatcgcttgagcctgggaggcggaggttgcggtgagctgagagatcttgccagtgcactccagcctgggtgacaagagcgagactccatcacat

SEQ ID NO: 27611 - DNA, 470 bp, Homo sapiens
  misc_feature 12: n = A,T,C or G
gaaatatctatngaacatactacatcaagtattatttcagtacaataatcttgtaataagcaccagcaatatgaaatatatctaagttttagcaaatattaggtgtctgattaacataatataatatgaactcatgcaaacgtattggtgactgagtaattgaatagggaaaaaaaatattttagaaatattttaattctaacctatatttctataaaatagtagttgtatcctatttgaaagcaaagcaagagaacagatatattagacaaattaaatttttgaatatacttctgtagcgaaaaaaagaaatcaagcaaaaattttagtaattggtacaaattaattacacccctacttcaaaataaaaataaacacaaaataacacaaacaaaaaagtacgcttattctgtatgatcctgttaaatatattaagaatatatgtgtcaataggtgtttgtcattccaga

SEQ ID NO: 27612 - DNA, 343 bp, Homo sapiens
  misc_feature 291, 306, 314, 324: n = A,T,C or G
tgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaangctaaaactaatcgncccaacanttatattacnaccactgacatgactttcc

SEQ ID NO: 27613 - DNA, 470 bp, Homo sapiens
agctgaaatggccgaaaactgtgagacatgctatggaagctgaatgccggacgctagcacagtttactttttccctttctaatcggctgatgttactcccacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatct

SEQ ID NO: 27614 - DNA, 393 bp, Homo sapiens
  misc_feature 231: n = A,T,C or G
ggctttccaactgcctgactgcttgttcgtctcactggtgtgggctccagcatcccctttgctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggnagaagtgcagctgctgtgcctgatgtgggaacagctcttctcccatatgtaaatagaacaacctgcacaacctggatttttttaaaaataaaacactgagccatttgctgcatttctttttatactaaatatgtgactgacaataaaaacaattttgacttt

SEQ ID NO: 27615 - DNA, 190 bp, Homo sapiens
  misc_feature 10: n = A,T,C or G
cacaaaagcnaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgcatctg

SEQ ID NO: 27616 - DNA, 238 bp, Homo sapiens
  misc_feature 17, 238: n = A,T,C or G
gaaaaaggttttcaagnaaaacattgaagaatgtatgatctgtgggtaaaactttttaataagacattttaaaaggctcattttaaaggatgaccacattgaaatgaaaacatcttcctaatagatactgttaaaagctgaaaagaaaagcagtacattaggaaggagatactagtcacatgcatacctaaacaaaagaacagaatctagtatatacagagaactccgaatcactgtn

SEQ ID NO: 27617 - DNA, 476 bp, Homo sapiens
catgttgcccaagcctggtcacaaacttcctgccttggcctcccaaagtgctgggattacaggcatgagccactatgcccaacctcagttggatgggtttgtgtgtatgtgtgtgtgttttgtttgttttttagtttttgagacagagtctcactctgtcacccaggctggagtgcagtggcacaatcacggctcactgcagccatgacctcttgtgctcaggcagttctcctgcctcagcctccttagtagctggaaccacaggtatgtgccaccacacccggctaatttttgtatttttttgtaagagatgggttttcgctatgttgcccaggctggtctcaaattcctgggctcaaacaatccacccacctctgcctcccaaagtgctgggattacaggtgtgagccaccaagcccagcctagctcctctacctgaacttatttttcattatcctaaagtgataaaatagatc

SEQ ID NO: 27618 - DNA, 112 bp, Homo sapiens
atataaaaggttgtgtacaactccacgaggtgaaaaatattcagtaacttgtttgcatagcatttgtgtaaagactatgatctcatcccaataaaatgatatattaaatcta

SEQ ID NO: 27619 - DNA, 472 bp, Homo sapiens
  misc_feature 24, 26: n = A,T,C or G
attcctatttgtatatacacgagnanaacccaaccagtgcctgtgtttggggggaaaagtcaacagtgtagttctaaaccttatcccaaacagaaaatgtggttaatgatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatgggatttactataataatccaagtatgacatagccggtatgctttcatgaatgtttttatggtaagattttcctcccatgaacatgagtaaataaatc

SEQ ID NO: 27620 - DNA, 347 bp, Homo sapiens
caagcaaaaaggtaactaactgcttgatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacga

SEQ ID NO: 27621 - DNA, 452 bp, Homo sapiens
cgaacacttgccaagtatttcaatccttgctatgccctgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatac

SEQ ID NO: 27622 - DNA, 431 bp, Homo sapiens
gctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcggaaaatcgttgtgaaagtgttgaaggcacaagcacagagtcagaaagctaaataaaaaaatgaaacttttttgagtaataaaaatgaaaagacgctgt

SEQ ID NO: 27623 - DNA, 309 bp, Homo sapiens
gtcgtcaagagaatagcgatggggtaggcaatgttttgggagcacagaagatagattatctctttcctgaaaatgggagttttgttatcttaattgttcaagataacttctggttgaaactcaagtttttctcaaacactttagtcttaatttagtaatactctcttttagtattaatgaattattaactagactgtaggccgggcacagtggctcacacctataatcgtagcactttgggatgctgatgtttgagcccaccaggagtttgagccaagcctgggcaacatagtaagacctcgtctctac

SEQ ID NO: 27624 - DNA, 215 bp, Homo sapiens
aaccctgagattcttactactgatgagaacattatctgcatatgccaaaaaattttaagcaaatgaaagctaccaatttaaagtttcggaatctaccattttaaagttaattgcttgtcaagctataaccacaaaaataatgaattgatgagaaatacaatgaagaggcaatgtccatctcaaaatactgcttttacaaaagcagaataaaagcg

SEQ ID NO: 27625 - DNA, 480 bp, Homo sapiens
atttcaaggatgtctatagaacatcaaagacaaaatcagttttttgccctttcccagaattcctgtccacgtccctaaccctttctctgatctgtcccattgttttctgagttaggacttctcagagagaacagctgctgtcctcatctgtcctgtcctcacctgcccaagagtctcacctggaggtagacacatccttctcctgtcactttcatgctgtattccccaggcagctctggcaatgagacctgctgcagtaacaggcggttgttgttgtccacttggaatttgctggaaaatgtccctgaagactggatagtcacctgtgcagccttcccagtcctggtaaatgtggctgctccatatttggacagagcatggagagccaccactgtgtcctgttagagacagatgagtgagagaacccattgggcattataaggctttgagggctgagatatttttcaaagacccatgtga

SEQ ID NO: 27626 - DNA, 482 bp, Homo sapiens
  misc_feature 172: n = A,T,C or G
aagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcangtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctccatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgta

SEQ ID NO: 27627 - DNA, 271 bp, Homo sapiens
ggagaccatttttccttgggcccttgccgcactcctgagtgttggtaagagtaaagaactaagtcttgacacagctgtaaaaacagacagcgcctttggcctcagcactttctcctggtgcaggcagatttcagatgtaaatttcactctctgcctctcctactaatgaagtaagtttcttttgctgggtttgcagccaggtgtgtccagtcttgtggctaaccagggcgctttacttaatttttccatttgtgacatttcaaccaaacct

SEQ ID NO: 27628 - DNA, 370 bp, Homo sapiens
  misc_feature 14, 359, 369: n = A,T,C or G
ggcttaaacaagcnaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattcctggaaccagaattacatgttaatgaacagtgtaccttttaacagtgtaaatcacggaatatccgtgaaggggatttccttaatttatttttttaccnggtggattgna

SEQ ID NO: 27629 - DNA, 118 bp, Homo sapiens
cactgcgcgggcctgaggctgctggatacaatgttgggcaacaactcagccagcctgatggcagcctcagaggcttactctaacccatcccagaataaatggagacttcctgtgtggg

SEQ ID NO: 27630 - DNA, 470 bp, Homo sapiens
gatctatcctttacggcaagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggagggagtgtgacttgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacattcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatc

SEQ ID NO: 27631 - DNA, 481 bp, Homo sapiens
ggctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcagga

SEQ ID NO: 27632 - DNA, 470 bp, Homo sapiens
  misc_feature 8, 11, 38: n = A,T,C or G
gtgtacgntgnctgagaaagaggtggtccaaataatantctgttgaaaaatatgaagaaaattgtggaatcaaaaacacaaagcttgctcctgagaccaaggctgtcattcattggattatggatattccttttgtgctttctgccaatctccatggaggagaccttgtggccaattatccatatgataagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagact

SEQ ID NO: 27633 - DNA, 472 bp, Homo sapiens
gaaatgatagattctttaaatacttttttccctgaatgaagggattttcaatagaaggaaatggccagaaaacatctcagcatttttatgtctatataatgcaaggagtctcagatgaatttatatgcttaagtaacacagatgaaaattgtgtaagctttttcccctttttgccttaactgccaagaaacctggagccactgtaatcagttcatctcaggtgcctgttaacatctaacccgtgttcccgacggccttgcttgtgttttcatccctaattgggtttagttctgtaagctgaatcgcattcctttataagtccatagcaaactctatataaattgaatagagctgaaaaatatattaactcgaccaaggttttatagctaatttacagttgcctacaatagtaatgcatgattgaactaatgacagtcctataacaaaaacactaatgacatttgtttttaac

SEQ ID NO: 27634 - DNA, 376 bp, Homo sapiens
  misc_feature 29: n = A,T,C or G
atacttggagaatctttccgtctttagtnagagaaagagatgtgacgatggtagcagactcagacacgtgcttcatcactggctttgaagaaggaagaagaaggctgcaggccaaggaatgcggctaccctctagaagctgcaaaggcaagaatggtttctcctctagagcctccagaaaaagcccaggctagctgacaccttgattttagtccaatgaaaactgtgtcaggtgtctgacttccagaactgtaagataacaaattttgttgttttaacccactaagtttgtggtactttgttatagcagtaatagaaaactaatacagttttgttgttaaactatacaagatttaaaaaatatattgttaacatgc

SEQ ID NO: 27635 - DNA, 196 bp, Homo sapiens
gattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagaggg

SEQ ID NO: 27636 - DNA, 435 bp, Homo sapiens
  misc_feature 22, 431: n = A,T,C or G
gattaagaatctcactcaaagnccgctcaactacatggaaactgaacaacctgctcctgaatgactactgggtacataacgaaatgaaggcagaaataaagatgttctttgaaaccaacgagaacaaagacacaacataccagaatctcagggacacattcaaagcagtgtgtagagggaaatttatagcactaaatgcccacaaaagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaatnaaga

SEQ ID NO: 27637 - DNA, 495 bp, Homo sapiens
  misc_feature 3, 11: n = A,T,C or G
tgnttatggtncgggggcaagtacagatattaattatgagaaattgcagtacacctaataagcataattagggcatgaactaaagtaatgtcaatagaatagaaaaagtatacgaaaccctttcttatagtgaaggaactcagaatctgtttgaacatggagtatagaagggaaaatgtaaggtttcactttgaacaatagaaagtatgctggtggtattattcctgaggatagcaaagccaggagaggcagccagttgcgggagtagaaaatataaattcgtgcaagatggttgaatagaactctccagccattgtcctccctacaggaacaccaaattgaacaattatccacacaagaaagtacattcataagaaccaaaaatcaggtcagcaatcatagtacctcattttaacattatttcaagcaaagaggcacagaagagggtaagaaagacagtcttgaattccctataccaaccctcccccacccctt

SEQ ID NO: 27638 - DNA, 481 bp, Homo sapiens
  misc_feature 12: n = A,T,C or G
ggtcctgacagnagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcata

SEQ ID NO: 27639 - DNA, 362 bp, Homo sapiens
agtcctgacacagttacagatgtaattgaggctgttgttcagagtgtaaatctgaacccagaacataaaaaggggttgaagagaaaaggttggctattggaagaacagaccagaaaaaagcagaagccattaccagaggaagaagagtaagagaataataaaagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagacccaaagagtcgattgat

SEQ ID NO: 27640 - DNA, 251 bp, Homo sapiens
gaagtcagtatttttttattgccttaaaaagaaaaattttgcaattacccaattcagtttttttgtccccccaacacagggtttcactctgttccccaggctggagtatagtagtgtgatcatggctcactgcagcctcaaccacccaggctgaggcgggagaatggcttgagcccgggaggcggaggttgcagtgagccgggatcgcgccactgcactccagcctgggcgacagagtgagactttgtccc

SEQ ID NO: 27641 - DNA, 471 bp, Homo sapiens
gtctacgtgcgctctgccattcaactcggaaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcatta

SEQ ID NO: 27642 - DNA, 372 bp, Homo sapiens
gttgttctgcatgtggttgcatgcaggatatcccacacttcccttagtttgcccaatcccaggtctggttaagagcaaaggagatctaaggggcagtcatggcgggcccattagaccccaggttgattccaagccccaaggagttgaaaaaaaaataactggaggtgcagggggagcagtaatggtcaaggctatttctagaaactctgactctgttgacattgacccaggaactcagatgggccagttgcctgagtacacatgagctgagggatggggtgtgggaaaggattctgatctagcagtagtgaatctgcttgcagcaagctggaagatactgccatggatagaaatcaggctgtggtcaacatg

SEQ ID NO: 27643 - DNA, 470 bp, Homo sapiens
atgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccag

SEQ ID NO: 27644 - DNA, 445 bp, Homo sapiens
agtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccgtttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggaatttggtgttttacagtatatcttaaga

SEQ ID NO: 27645 - DNA, 468 bp, Homo sapiens
ggccgtggtggtggtggctgtctttcttgtctgctggactccataccacatttttggagtcctgtcattgcttactgacccagaaactcccttggggaaaactctgatgtcctgggatcatgtatgcattgctctagcatctgccaatagttgctttaatcccttcctttatgccttcttggggaaagattttaggaagaaagcaaggcagtccattcagggaattctggaggcagccttcagtgaggagctcacacgttccacccactgtccctcaaacaatgtcatttcagaaagaaatagtacaactgtgtgaaaatgtggagcagccaacaagcaggggctcttaggcaatcacatagtgaaagtttataagaggatgaagtgatatggtgagcagcggacttcaaaaactgtcaaagaatcaatccagcggttctcaaacggtacacagactattggcatcag

SEQ ID NO: 27646 - DNA, 200 bp, Homo sapiens
  misc_feature 60, 104, 149, 175: n = A,T,C or G
ccttgatgtgcagcgtggcattccttcgacttctctccagccgagcttcccagaacatcncatatcactgcaaaaatagcattgcatacatggatcatgccagnggaaatgtaaagaaggccctgaagctgatggggtcaaatgaaggngaattcaaggctgaaggaaatagcanattcacctacacagttctggaggat

SEQ ID NO: 27647 - DNA, 399 bp, Homo sapiens
  misc_feature 19: n = A,T,C or G
gagggaaaattatgacagnaggttactctagcctgcttaaaagagattttggggcaaaaactcagaatggtgtttacagtgctgcaaattacaccaatgggagctttggaagtaattttgtgtctgctggtatacagaccagttttaggactggtaatccaacaggggcttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaaga

SEQ ID NO: 27648 - DNA, 356 bp, Homo sapiens
  misc_feature 25, 78, 100, 112, 133, 178, 188, 206, 231, 253, 257, 280,289: n = A,T,C or G
gcaaattggttatattaggtggctngactaatgttttttctataattgtatatggactgcgtttttaaaaaaaccgcntttgcctttatgctagattgtnaaaaattatatnagaatgcataagacatgtttntccttcatatgctagacttttcctagcatttcgtatttctgtgcngtcagtgtgngatttttaaaccggaatntggtttaaaaaaaatctggtggtancatatgtgagaaatactttggngttnaccttatgaaaataaaggattgnaagtaaagnttcctgcgcaccttataccagaattcagtataatacactactttctgtgttcaaacagataaatcat

SEQ ID NO: 27649 - DNA, 472 bp, Homo sapiens
ggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttg

SEQ ID NO: 27650 - DNA, 463 bp, Homo sapiens
ggctctctgaccgcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatca

SEQ ID NO: 27651 - DNA, 476 bp, Homo sapiens
  misc_feature 17: n = A,T,C or G
gactacggtcctgccgnatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtgtgtttttattactggtttaatggagtaatggtacttttattctttcttgatagaaacctgcttacatttaaccaagcttctattatgccttcttctaacacagactttcttcact

SEQ ID NO: 27652 - DNA, 496 bp, Homo sapiens
  misc_feature 5, 12: n = A,T,C or G
cacanggccttnggtgattatggtccgggggccgccttcgccgctggctccgtctgttgggggacgaacacgccgcggtcctcgtcgtgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggtggtttaagcccatcgagcagctgctgggattcaccccctcttcaggttgatactgcctggatggtcacctctggtgcgcagcaagtgcaaagccagt

SEQ ID NO: 27653 - DNA, 464 bp, Homo sapiens
catgatggttatgaaagcatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgt

SEQ ID NO: 27654 - DNA, 101 bp, Homo sapiens
gtagcctgatgtgacatggcaggcattgggttcttggatagatgtagtcacaacagtaaaaactgttcgaccatttttggaagtactcagcttcactttcc

SEQ ID NO: 27655 - DNA, 498 bp, Homo sapiens
  misc_feature 8, 11: n = A,T,C or G
acagggcnttnggtgattatggtccggggagtgagggacagaccaagcacgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaact

SEQ ID NO: 27656 - DNA, 470 bp, Homo sapiens
  misc_feature 358, 390: n = A,T,C or G
aataaagaaatatttcgtatttgcagcctacctttaaagtattgaagcataattgtgaaacatttacaagttgctgagttgtcacttgtggaaatacaaaaaagaaaaagaaaaattgataaaccattgtcttatgatttcaaaaatttcacgggaagggggcagataataagtggttttatgcctataagttatttagaattccacatatttttaaaagggggttttaatatgttgttatttgacctgctttgagatgtctacagtcttgacttcttgatatctttgtatcttgttacagtcttattattacaagcagtgttaggcaattaaatttggaatttttttttttcaccanatgtatctgagtttctacagcaaacttgttanaaattgtgaaggcattttggattaagttaaaagtatacattgtacaacttgattatgacattaatattcaatgagcttat

SEQ ID NO: 27657 - DNA, 414 bp, Homo sapiens
gaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcat

SEQ ID NO: 27658 - DNA, 476 bp, Homo sapiens
  misc_feature 19: n = A,T,C or G
ggaacaaagctggacgganaatgactttgacgagttgacagaagaaggcttcagactactggtaataacaaacttctctgagctaaaggaggatgtttgaacccatcgcaaacaagctaaaaaccttgaaaaaagattagacaaatggctaactataataaacagcatagagaagaccttaaatgactggatgaagctgaaaacacatggcatgagaactatgtgacacatgcacaagcttcaatagccaattcgatcaactggaagaaagggtatcagtgattgaagatcaaatgaatgaaatgaagcaagaagagaagtttagagaaaaaagagtaaaatgaaatgaacaaaacctcccagaaatatgggactatgtgaaaagaccaaatctacgtcttactggtgtacctgaaagtgatggtgagaatggaaccaagttggaaaacactcttcaggatattatccaggagaac

SEQ ID NO: 27659 - DNA, 473 bp, Homo sapiens
ggaaccgacctattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacattta

SEQ ID NO: 27660 - DNA, 296 bp, Homo sapiens
  misc_feature 150, 248, 255: n = A,T,C or G
catggtagctcatgcctgtaatcccagcactttgggaggccgaggtgggtggaacacttgagtccaggggttccagaccatcctgggcaacatggtgaaaccctgtctccacaaaataaaaaaaaaaatgaaaaaagtaaagtaaattanccaagtgagggggtcactttgcctgcagtcccagctactcaggagtctcaagcaggaggatggcttgagcccaggagttcaaggctgtcatgagccgngactgcnccactacacttcagcctgggcaaggagcaagaccctgtccc

SEQ ID NO: 27661 - DNA, 288 bp, Homo sapiens
gaggcattgaggcagccagcgcaggggcttctgctgagggggcaggcggagcttgaggaaaccgcagataagtttttttctctttgaaagatagagattaatacaacttcttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggtcgagatgaagcttcttcatggagc

SEQ ID NO: 27662 - DNA, 370 bp, Homo sapiens
catcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaag

SEQ ID NO: 27663 - DNA, 471 bp, Homo sapiens
ggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatatatgtggaaaaacaaaacacttaactagaattctctaataaggtttatggtttagcttaaagagcacctttgtatttttattatcagatggggcaacatattgtatgaagcatatgtagcacttcacagcatggttatcatgtaagc

SEQ ID NO: 27664 - DNA, 471 bp, Homo sapiens
  misc_feature 14: n = A,T,C or G
gaggagctgaaatngactgatgggtaaaaggaagatagcctgggttggtggcctattagggaatgcctctctacacagggaccatgtcataatcgttttgataacattctttcttcttgcccctttagacctctggctcccttgcccagcttttgatattttgttgttgtttgttctgagaagtaaaaatatagctagagctttgcactcggtcatgttagtattttaagacactcccaagagtggaagagagaactgtcctccagttggagttatggggaggttccctgtgctccacctttcccacccttttctgtctacctgtgtgcacggaggcatgagtggataccgcgtctccacgggtgaaaggacaagtgatccagctgaggagagttgatcttttggtttaaccaaaccagacacccaaacctagatttccaaggcatgtgaacagggatgtgcatgacagtc

SEQ ID NO: 27665 - DNA, 254 bp, Homo sapiens
  misc_feature 9: n = A,T,C or G
tctcacagnatattccttttgttcaattagaaattctacataattctggccgagcacagtggatcacttgaggtcaggaattcaagaccagcctggccaacatggtgaaaccccgtctttacttaaaatacaaaaattagccaggcgtggtggcgggcacctgtaatcccagctactcgggaggcagaggttgcagtgatccaagatcacgccattgcactctagcctgggcgacaagaaagaaattccatctc

SEQ ID NO: 27666 - DNA, 260 bp, Homo sapiens
  misc_feature 11, 20, 257: n = A,T,C or G
caccacagggnaattcggcnttatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtnagg

SEQ ID NO: 27667 - DNA, 118 bp, Homo sapiens
  misc_feature 20: n = A,T,C or G
ctgatgagaatttattaatntcttagacgtaataatggctattttggattttgtagaggtttttaaagattttttaaattcgttttatctttcagaaatatatactgaagtatgaatc

SEQ ID NO: 27668 - DNA, 170 bp, Homo sapiens
tgcttttttatgggtaaaggaaggcaaatgacagttggtggtgaaaagaaaaaggagtgtggggactggagtactaatttggaacaggtgttgatcatttttgcctagaataagtagtgtaactgtaaacaaatattcttctaaaagaacggctcaaagctatgaaggct

SEQ ID NO: 27669 - DNA, 481 bp, Homo sapiens
atgggtctatgtgaaagaccaaacctacgtttgattggtgtacctgaaagtggcggggagaatagaacctaattgaaaaacacatttcaggatattatccaggagaacttccccaacctagcaaggcagaccaacattcatattcaggaaatacagaaaacaccacaaagatactgctctagaagagcaaccccaagacacgtaatcgtcagattcatcaaggttgaaatgaaggaaaaaatggtaagggcagccagagagaaaagtagggttacccacaaagggaagcccatcagactaatagcatatctctctgcagaaaccctacaagccagaagagagtggggaccaatattcaacactcttaaagaaaagaattttcaacccagaatttcatatccagccaaactaagctttataagtgaaggagaaataaaatcctttacagacaagcaaatgctgagaaattttgtcaccacca

SEQ ID NO: 27670 - DNA, 210 bp, Homo sapiens
gtgatacagaactcttaaaaatttttttttgtgttttataaaatcaagttttaagtgaggaaataagtttgttaaaaacaaaaaaagaagcaagtggatttgtgtggtgtaatttgcctgctcatataatccactcatttttctatagcatcatttattgatttgtagaacctctttatatagtatgaatattatcttttatgtatgatg

SEQ ID NO: 27671 - DNA, 460 bp, Homo sapiens
agatttactgagtgctggccagctgcaatgtctcacatctgtaatcctagcaccttgggaggccaagatgggaagatcgcttgagcccaggagtttgagaccaacctgggcaacatagtgagactttgtcttcaattaggaaagaaaggatttactgagtgctaatcaaagcctcacaatatgtaaccacttgcttcattgcctattctccctcctttttttcttcctttaatgcttgctctttcatcttaaaatattgaagtttcaaaaactctatctggaaaaagcacaagtcacagattctactataagttgtgtttccttttcctaggtgcatcctcaaccttggcaaaataaacctctcaacacttgagttgtgcctcagtcactttttggtttacacatcttaagaagtgagaaaataaagagctaagtaatctccaagaaagtagagggaaat

SEQ ID NO: 27672 - DNA, 261 bp, Homo sapiens
gtgtatccaaaaatagcatttggatttaagctttctgaatttggtagtttaagaaacagatttagtttttcagtggttttaactcatgtgaaataatgattttccaccagctctgatgcaaagagatataattttaatgaacgatttatccagcagtttgttccaggggttgcctctccttatctacggggattactttgtacatgcagataagttttcgcaaacctatttccattttcttttgtaagtaaataaaacttt

SEQ ID NO: 27673 - DNA, 100 bp, Homo sapiens
cgctctggatcctgcactctaacactcgactctgctgctcatgggaagaacagaattgctcctgcatgcaactaattcaataaaactgtcttgtgagctg

SEQ ID NO: 27674 - DNA, 246 bp, Homo sapiens
aagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggtttggtaaataaacaattctttt

SEQ ID NO: 27675 - DNA, 173 bp, Homo sapiens
  misc_feature 28: n = A,T,C or G
ggcagagagaggcactttgcaccacagnacagatagcaagaagggaaagacagagagtgagaaaaaagaggagtcagtcgctcctggggaagggagagagtgagactgggagaaagagaagcacagaaagtgtgtgtaaaacggagtaaagaaagaaaaaaaaaaacctcccc

SEQ ID NO: 27676 - DNA, 446 bp, Homo sapiens
gggagaagaaggcggtggtggcgggtggaggttcgagcgctgttctcgctccggagccgctgcacatttcggaatcttctgcggcttgtccatagtgtgaataaaaactaaatcacatctataattctactgaactggtcatacagacgctgccatatatgtcacagtacactgaaaaggagccagcagcaatggaccaagaatctggtaaggctgtctggcccaaaccagcaggagggtgtcagacaattacaggcaggagatatgggaagaagacatgcttatgtcagttttaaaccatgtatgaccagacatgaaagaagcttaggtcgggctggtgatgctatgaagtgttggacctagaatgatgttccaaaggaaaattcctcaggttccagtcctttggatcaagttgattcttctttacccagtgaacctatatttga

SEQ ID NO: 27677 - DNA, 185 bp, Homo sapiens
  misc_feature 37, 38, 50, 53, 66, 80: n = A,T,C or G
tggcccggggttgatgtaccttacagacaccaagaannaatctttgctanaanttgtacaaagccntaaacgtaccaaanttactgtttaaactggcttggtgtctttcttttctaattatgcagaataagctctttattaggaattttttgtgaagctattaaatacttgagttaagtcttgtc

SEQ ID NO: 27678 - DNA, 354 bp, Homo sapiens
gggctgagtgaggaagaggagtgctgttcctgccttcctagcccagctgggtctgaccagaggctactgtgtacccatttaccatgcgtgattgttaactcagagtggggtgtagccaggtattgactgaatgtatgttcttgctgacctgtgtttttttctgtagggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgc

SEQ ID NO: 27679 - DNA, 375 bp, Homo sapiens
  misc_feature 12, 53: n = A,T,C or G
attggccggggnatgtgaaaatactgtgaagaaaattgccctggcaccttttnagactttgttgcttgaaatgcacagtgcagcaatcttcgagctcccactgttgctgcctgccacatcacacagtatcattccaaattccaagatcatcacaacaagatgattcacttctggctgcacttctcaatgcctggaaggattttttttaatcttccttttagatttcaatccagtcctagcacttgatctcattgggataatggagaaaagctagccattgaactacttggggcctttaacccaccaaggaagacaaagaaaaacaatgaaatcctttgagtacagtgcttgtccactttgtttacaatgtcctcc

SEQ ID NO: 27680 - DNA, 445 bp, Homo sapiens
ggtactcgtcttggtgagagcgtgagctgctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttt

SEQ ID NO: 27681 - DNA, 172 bp, Homo sapiens
accgcgctgactctaacttttttattttttgtcgagatgcgattttgccatgttgcccaggctggtcttgaactcttgagatcaagcaatctgcctgccttggcctcccaaagtgctgggattacaggcgtgagccatcgtgcccagccaagaaaaaaggtttaaaagagag

SEQ ID NO: 27682 - DNA, 405 bp, Homo sapiens
  misc_feature 8: n = A,T,C or G
aacttttnatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatga

SEQ ID NO: 27683 - DNA, 173 bp, Homo sapiens
  misc_feature 1, 32, 64, 65, 69: n = A,T,C or G
natggcccgggaactttggaatgtgtcctgtnaggcatttcgtttatacacacatatatcttannttgnaaattggggttactggtgcaatttttctaacctgctttttctcccccatttaacagcgtagtgtatccatgtttccatttcaataaatattcttctacaacatc

SEQ ID NO: 27684 - DNA, 470 bp, Homo sapiens
atgaaaaggaaaagattttgacctgaaaaacattgcttcaaggttgattttgtgagtattcaaagtcatatttaatttccaggtaatggcaattcttataacctgaattcaccagtacccatcaactgcggacaggcccaccctttataactgattatgggttcttctcttgaacctcccgtggtgtcagattaattatgagtaacctggcaaggagtaatagccataagtaatagatcccctgagaaggaaagagggctaaatagatagagaaacagaattctaagctcttttagcccccataaacaaagatggtttaatctttagcaaaacatttccactcccaccactgtagagaaaacatggcactataaagttatttatctttatccaagccatattctctaatcaagattttaaaaacgggataaaattcattaccagcttcttgtcttgcaaatggtaaggga

SEQ ID NO: 27685 - DNA, 471 bp, Homo sapiens
ggaaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatgccgcatttggattgggatgaattccaaattctgcttgcttgctttttaatattgatatg

SEQ ID NO: 27686 - DNA, 500 bp, Homo sapiens
  misc_feature 14, 19, 33, 53, 90, 403: n = A,T,C or G
tgggcccggggaanggtcnagggagcctctgangcctggcagcccttaaagangccaagtgccattgaaaggacaatgactgtggggaangcccgtggggcagctcttttcatggcttgtacaccgccctcagctcctggcaattagctggactccatgacccacccctggtgcagcatagatccgacgtctgtctgggcgaagggtaggggtgggtaaggggcgggaagcctgagtgcaaatgtcatttccctctactgcctcttcctgcctctccccaccctgcccacatccacagaggggagagaagggtcatagctaaatgcaacaaactctgtatcttgtcccaacctgcttttctgttctgttagcatatcataaagtaagcctttctggtgaaggnaaggttgctatgaaactttttttcttggtgggaaatggccaagtttaggcactctgctttttgccttacactaatgcttagaaagctgtcttttcag

SEQ ID NO: 27687 - DNA, 497 bp, Homo sapiens
  misc_feature 3, 12, 46, 443, 469, 478: n = A,T,C or G
aantgtgaagcnaggcgctggcttgctgagccccaaggccaaggancccctttcgctcacctgcccaagagtacccttttgtgttggatgaatttaagcgcaagtacctccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggaganccagacgctggttcgagagtactttnctggggaangggggccttccagcatgtg

SEQ ID NO: 27688 - DNA, 192 bp, Homo sapiens
  misc_feature 9, 14, 25, 28, 58, 182: n = A,T,C or G
tcccgcccnaggcntgggaagtgcnaantgggtgccgaatctttgggcttcacttgcnaacctcttgcccccggggcttgaggcgggagaagtcgctttgaactttgggaagcagaggttgcagtggggagcctgagaatcacacccactgcattccagccctgagcgacagaagcgaaganctcttcttcc

SEQ ID NO: 27689 - DNA, 106 bp, Homo sapiens
  misc_feature 53, 72: n = A,T,C or G
cccggggaaactcggccctttattggcccgggggcttgtagtgagcctgagancgcacccactgcacctccntcctgggtgacggagtgagaccctgtctcaaaga

SEQ ID NO: 27690 - DNA, 130 bp, Homo sapiens
tgtggccccttagctactaagggaggctgatgttagaaaggattgcttgagtcccagaggtgtaggctgcagtgagctgtgattgcaacaattgcactccatcctgggcaacagagtgagatcctgtctc

SEQ ID NO: 27691 - DNA, 488 bp, Homo sapiens
  misc_feature 12, 33: n = A,T,C or G
gcttcttttccnttcggtgtgccccctgaagancctggtgtcgccatgggcccgcccgcccccgccccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggcttgacaggctccaaacaggcatgcgaggtgcctttggaaagccccagggcactgtggccagggttcacattggccaagttatcatgtccatccgcaccaagctgcagaacaaggag

SEQ ID NO: 27692 - DNA, 329 bp, Homo sapiens
  misc_feature 12, 13, 44, 45, 50, 289, 323: n = A,T,C or G
gaacctccggcnntttatgggcccgggcccttctttaagttttnnttaantgaaaagaacccctaaagtgagtgagttcctaaacttgagactcgtaggcagagtgaagcatgtcttcattttagcttcagagtttaaaagttatcaatattcttttgagagtgggaggacctgagtcacagttttaaatgtcaactgtactagctgaggtcattaattccccttaccttcacgtttggccaaaaatgaagagaaaaatattttctgttttttttttaaataccacagngttcaggttcttgatatgagtaaatcacttttgncgggga

SEQ ID NO: 27693 - DNA, 458 bp, Homo sapiens
  misc_feature 438: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttaaaagttgtagggtgattaaaataattttgnaaggcgatcttttaaaaaga

SEQ ID NO: 27694 - DNA, 473 bp, Homo sapiens
gggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctat

SEQ ID NO: 27695 - DNA, 277 bp, Homo sapiens
  misc_feature 3, 4, 24: n = A,T,C or G
acnntacctgtttaccagtttganggaattgtacaactttaatactttctcttgtactgtagtttatattttatttacagatttttttgtactgtgtgatttgaactttttgttccttgctatgatcaatgtttatgtagtagagcacttatgatcacaaattaagttttttggtttgattgcactacattaaattttttaatgcagttctgatttttgactggactaaaactgtgtcttaatgtatgtgatgagtacttaaaattttaatccatgt

SEQ ID NO: 27696 - DNA, 279 bp, Homo sapiens
  misc_feature 7, 20, 46, 59, 60, 136, 144: n = A,T,C or G
aggcctnttaaaaccaaccntaagtaccaccctaaacctgcctganaactgttgctttnnaaactacttgtcacacttgactttccctttttctttacttttacaaggcaaataaaaagtgaaaagaccctggaantatatttnaaatttcagtcaatagtgaaatatttctttgaagccactccctctgcccaacccttttaatgagatgagatactgaatttcttttctctagttaatattagaatgtgggcatttattatgttttcctcactttta

SEQ ID NO: 27697 - DNA, 119 bp, Homo sapiens
  misc_feature 17, 33, 97: n = A,T,C or G
tggctctgggccctgangggaccaggggtaganggaaggtgagcactagcaccttttcctagagccgagaattgggggaaagctgttatttttctanttaaaataccttcagatgtatt

SEQ ID NO: 27698 - DNA, 135 bp, Homo sapiens
agccatgggaatacagaatgatagaagagactacagatggataattggacttaagccatgagctctgagttcttgtaacataaaactttactttagaagttgtgaaatgtatttaaaactgaattctgtaaatag

SEQ ID NO: 27699 - DNA, 258 bp, Homo sapiens
gagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcatttttttt

SEQ ID NO: 27700 - DNA, 496 bp, Homo sapiens
  misc_feature 10, 11, 30: n = A,T,C or G
aatttcggcnntttatggcccgggataatncttgttccttaattagggaccctgtatgaaatggctccacgagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgaccctcgatgttggatcaggacatcccaatggtgcagccgctattaaaggttccgtttgttcaacgatttaaagtcctacgtgat

SEQ ID NO: 27701 - DNA, 318 bp, Homo sapiens
  misc_feature 10, 17, 45, 48, 65: n = A,T,C or G
taaaagggantcccttntcagtttttagccaggatgctttaaganatntcaacggataactgacntcgttttgttaagaagttaactgtatcatagctcactactgccagagcggcaatggatgtacaacgaaagagatgaaaaatacaaaagttattaagccacctgattaaaagaaaaccaatatttaaaggcatttaatagatatcaagtataactttgaggagaagaatcaatctgtattaccaaaaaaaaatgttttcattttctgtaagatacaatgaactggtacattaaaagtcaatttcgtgttactac

SEQ ID NO: 27702 - DNA, 193 bp, Homo sapiens
  misc_feature 11: n = A,T,C or G
atggcccgggnaaacccggcaccggtttgatccggaaatatggcctcaatatgtgcccgccagtgtttccgtcagtacgcgaaggatatcggtttcattaagttggactaaatgctcttccttcagaggattatccggggcatctactcaatgaaaaaccatgataattctttgtatataaaataaacatttg

SEQ ID NO: 27703 - DNA, 163 bp, Homo sapiens
  misc_feature 25, 29, 36, 51: n = A,T,C or G
tggcccgggaacctgtatttttgtntctnaagcctnttttcctactgttantgtgtcaatgtatcatctctcagaaaggttttacaatccaaacattattattgttctctgtgtaactgaatttcacttatcttttattaaaccagaaacattaattgaaaat

SEQ ID NO: 27704 - DNA, 374 bp, Homo sapiens
ggaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcac

SEQ ID NO: 27705 - DNA, 283 bp, Homo sapiens
  misc_feature 13: n = A,T,C or G
gactaaagtaacnagcagagattttggtgactgcaacatgacaaagaacacagactaaacagaattagtcgaggaaaggtactagacataccaccattgcaataaaaataacaaatagtaacaaactctacaaagatgggtgtgggacaaatctgatttgcagagttgccaccttatattatttaaattttccagttttcaacaacaacaaaagatgtgaagaaacagcaattacagccgcctatatatgggggaaaaaacttagaaaacagaaaccatccct

SEQ ID NO: 27706 - DNA, 470 bp, Homo sapiens
  misc_feature 413, 441: n = A,T,C or G
agaaaaggctcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagtttgcagatttattttaaaggnaagttcctgaaatgactgagatatttgnaagaaaaaaatgaatcaggatcatgcctt

SEQ ID NO: 27707 - DNA, 249 bp, Homo sapiens
agaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgg

SEQ ID NO: 27708 - DNA, 473 bp, Homo sapiens
gatcgaaatccccaattgatgacttaataaaatctggaatattgcccattttagtccattgtcttgaaagagatgacaatccttctttacagtttgaagctgcatgggctttgacaaacattgcatctggaacttctgaacaaactcaagcagtagttcagtccaatgctgtgccacttttcctgaggcttctccattcaccccatcagaatgtctgtgagcaagcagtgtgggcattgggaaatatcataggtgatgggccccagtgtagagattatgtcataagtcttgggagttgtgaaacctttactttccttcataagtccatctattcctataacattcttaagaaatgttacttgggttatggtcaacttatgtcgccacaaagacccaccaccaccaatggaaaccattcaggagattcttccagccctttgtgttttaattcatcacacagatgtaaatatact

SEQ ID NO: 27709 - DNA, 472 bp, Homo sapiens; identical to SEQ ID NO: 26578

SEQ ID NO: 27710 - DNA, 473 bp, Homo sapiens
ggagcgttcaataaatgggtgcacacaaatgtatacacactttgtttcttgttactaggaagcagccaaacagagaagatggcttttcctaagataatatattggtagtttttcataggtaactgaaaaacttggggcagctcaagtgctattaaggattgaagtaattaatgaataaatcgcagaaactatatcttcttattttgtgcttatagtaaacataaagtctgttggagaaggagaaagcttatggcatttgtacatgtccccagttatctggcagctatttgaattacatacttttttaaaagccaagttaggggaacgggtgagggagagaatcattttacattatgagtaagattcatcatttattcaataaagaactgaactatgctaagtagagagattctactcatgggtaaatgggagaatgaagatactatcttgctcttgtgggcattttccatgta

SEQ ID NO: 27711 - DNA, 392 bp, Homo sapiens
ggtgtatacctacctcggggtagacactcctcagtgacatcagtgctcttcccaccttttccaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaaattgtcacactaacttaaaagacagggtgagggaga

SEQ ID NO: 27712 - DNA, 482 bp, Homo sapiens
  misc_feature 443: n = A,T,C or G
tgaaaacactttagagtattggaatggctggcttctctttccttcctgtgagctaggaatgctggatcatccacagtggatagttgctagctgttgattttgcagttgtggcagttgttaaaatgggtggacttatttgggtgattttgggcaagcttaatctcataggaaaatctttagcctagtcaggtttttaatcgctatgttagtcatcctactgattacataaggaacacggtaggagcatttcaaatgccatcagctcttggcagcggaatgacaatgaggatgaagtattaaaaactaggtactcataaaggcagtcatggagaggggcctacaactccctgctcctgaatatgcctcgacattaattctgctccttataagagaactcagtggaagaaaggcataatttgaattaattatttgcacatatgggngtgttcctgatgtcaactaatgctacattaaggacagac

SEQ ID NO: 27713 - DNA, 338 bp, Homo sapiens
  misc_feature 6, 13, 330: n = A,T,C or G
acctcnggaaganttaactgtatagtccttcactcctcaaagaggaaactttattaagttgttcagttggttccatcctgataagtcttggtcaggcttgggaaaaaagttttcatgtgatttttaatgaaggagttctttacacctatagcctattgagagactagtgagctgccaaggaggtcaatgagtatggagaataaagcggtatacaaaagacaaagccctagagcctctttgtgaatgaataaaataaaattgggtgttagcccttgcacctaattcccaatctggccaaataggtgttatctttatacctctattgggcanggttccat

SEQ ID NO: 27714 - DNA, 472 bp, Homo sapiens
ataagttgttctttttggattcctttcttcttttcttatttatgtgcaccatctttaaatgattgtgccacagtacaacaaaaaaagattttcttatgaaaaattcttattttaaaagtggaagccatataatgtctaatttgaaagcttgtgattttttttctttacatttgaaatctcctttttcttttgctcaactaaatttattccattggaataatgtttttacttcagctctttgaagtacccaaggaagacatctaagctcaacttccccaagtacttgactgatttagtcccaaagtgctgggattataggtttgagccaccacgcccagctgtgttatgttttaacacaagtgctatgtcgctaagtggttggaaatatgaaaatgagttggatgtgttcttataataagacatctgctttagtatacattattagcatgctcttccttggaatttttatttt

SEQ ID NO: 27715 - DNA, 408 bp, Homo sapiens
  misc_feature 4, 407: n = A,T,C or G
aaanattttggggtgaaaggcaggaacagttctgtttttgaaatacaggttttctttgggattgttttcattttcaagtatagattcatgtcagaatggccaacttaacgtgggtttctgtattccctggtgttgctcttaacctgaactcataatcagttgccatactgaggcaagagcactcagggtgaacatagtcaagttactttaaaagtgataaaagtgtttttccatggtgaaaccttcagtatttggctgaatgtaaagtatgtttgaagtggtatatttgatggtaaagttgttaatcactaaccttgtttgcacttttgtacaccactgcttgcactaggatcttggtgtgaattttcaattgttttacagtgtatacagattattaaggataattnt

SEQ ID NO: 27716 - DNA, 470 bp, Homo sapiens
gaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgggattggcacattgtattacttactgcaagagatatttcattttcagcacagtgcaaaagttctttaaaatgcatatgtctttttttctaattccgtttttgttttaaagcacattta

SEQ ID NO: 27717 - DNA, 302 bp, Homo sapiens
  misc_feature 4, 10: n = A,T,C or G
atcnatggcnaacctgattaaggaagaattaaggagagtacaaatggaaaacatcccagttccatctaaccttccaaaaacagataatcctactgctattcaaacttgttagagaaagagccggatgctcagttctccatttccttttatgaaattagcatatacttaatatcaagcgcctggtaaagatgctgtatttagtttgctaaggctgtggtaataaagtaccacagactgaatgccttaaacaacagaaatgtattgtttcaaagttctagaggcaagaagtacccactgcccac

SEQ ID NO: 27718 - DNA, 439 bp, Homo sapiens
  misc_feature 12: n = A,T,C or G
gaatttaatgtntttgggaactccgggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtgggattttgtttatacacattttatttgtatcatttcatggttaaacctcaaataaatgctt

SEQ ID NO: 27719 - DNA, 291 bp, Homo sapiens
aaagtgggatattgtaaaagacatggggaaaggaagaattttatttcattttattttttcttattagaatattttttcttttcttaaattttattttagattcaagaggtacgtgtgcagtcctactacgttgtgcactagtatattgtataatggtaaggtttgcccattacccaaataatgaaaattgtatccatcggtaacttttcagccctcaccctcctttcaccctttccacttttggagtctccagtgtctattatttaagagaaagaattttaaatcttagct

SEQ ID NO: 27720 - DNA, 179 bp, Homo sapiens
  misc_feature 16, 18, 32, 33, 58, 63: n = A,T,C or G
gaacctcggcactttntngcccgggcccaganntaccctttgtaaaatagctcttttntgaanttagctgataaggctgtatgtttctggaacaaaatattggtcatctaaaaactttctgttttctggggtctgggaaaatagaaaataagatttcaaatattaaataagcttaaagg

SEQ ID NO: 27721 - DNA, 304 bp, Homo sapiens
  misc_feature 8: n = A,T,C or G
gattaaantaatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctg

SEQ ID NO: 27722 - DNA, 390 bp, Homo sapiens
  misc_feature 356: n = A,T,C or G
cagataagactattaagacagataagagccaaatcatgtagagcctcagaggtttttgatcttcagtctaagaacgtaaatccatggaagaattttaagcaggggtgtgccttgaccacattttgaattctaaactgtctctgggtgggtgtgggtgccaccaagagcatgtgttcatgtagggagactggttttttacagttgtctatgagagagatgacagttgcctggattatggtggtgacattggagataagcaggtagacagattctcagtgtattaggagagaaaaatcaataggaaatttaaaataaataattaactgtggccataggaggaaggagtctttgggttnggttctcaatttctgcatgagaaaaaaggtggac

SEQ ID NO: 27723 - DNA, 498 bp, Homo sapiens
  misc_feature 14, 15, 30, 39: n = A,T,C or G
cgggaatttcggcnntttttggccgggggnaggaagagnaagtcccgcctctctctcctcaggcagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagaatgtggacttgaggtacccaagagtggcaagggcaagaaagaagtccaagccagtcaacaaagaccgctacatctccaagatgttcctgcgcggggactcagtcttcgtggtcctgcggaacccgctcatcgccggcaagtaggggccgcctgtctgttgacagaact

SEQ ID NO: 27724 - DNA, 141 bp, Homo sapiens
  misc_feature 9: n = A,T,C or G
gcttgggangtgcagtggcgcggtctcggctcactgcaacctccgcctcccacatacaggagaatcgcttgatcctgggaggcggaggttgcagtgggctgaggttgcgccactacactccagcctgggtgactctgtccc

SEQ ID NO: 27725 - DNA, 253 bp, Homo sapiens
  misc_feature 15: n = A,T,C or G
tatggccgggaaccnctcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctat

SEQ ID NO: 27726 - DNA, 468 bp, Homo sapiens
atctcatttccttcaccttgcctcctcatacacaaatatattttcatttcttaaaagatcactgggccagtagttcaaaataatcctccaattttaatttaggaacaaagctttgtcctactgactaggaagtaaacaaacagctgatatataagatatttgtgggtattggtgtcttttttccctatggaatagacacatagttcccttaaatattattaatagacattctacagtctttcagtgtaagtttaaaagcaagagatcaaatgaaaatgtgtactatgtacctatgatgtgtcatatcgtgattacatcatgcagagagaacagttcctataattcaagtaattaaaatttcaagttgtaaaaatgttaccattttcacattggaagcccttctaagtaccattttcattgggggcagggagaaggtttatattttaaatttttatattaccagacatt

SEQ ID NO: 27727 - DNA, 230 bp, Homo sapiens
  misc_feature 3, 19, 31, 36: n = A,T,C or G
ccnccaggaaaatgtaacncttttagacgancttcntggcaaaaaattaagttctctagggaataagaagaaaagtgatgggaagtgaaaaaatcgtgtttgtgcgtaattttgaaaatatatcctcacaccctggaatgccagcacttttagagactgatatgaaaggctcacttgagccccaggagtttgagaccagcttagataacaaagggaaacactgtctccac

SEQ ID NO: 27728 - DNA, 466 bp, Homo sapiens
gaaatcaagatggaaatttaaaaattctttgaactggatgataatagtgatgcaacttgtcaaaactgctgggatacagcaaaagcagtgctaagaggaaagttcatagccgtaaatgcctacaatcatctgaaagagcacaggcagacaaactaaggtcacacctcaaggaactagagaaacaagaacaaaccaaacccaaacccagcagaagagaaaaaataacaaagatcagagcagacctaaatgaaacaacaaaaaaatacaaaagatgaatgaaatgaaaagctggttctttgaaaagattaacaaaatcgatagaccattagtgagattaaccaagaaaagaagaggagaagatccaaataagctcaattagaaatgaaatggggggatattacaaccaaaccacagaaatacaaaagattgttcaagactactgtgaaagcctttatgcatacaaatc

SEQ ID NO: 27729 - DNA, 126 bp, Homo sapiens
  misc_feature 104, 108, 115: n = A,T,C or G
attttaatagatgaccaatagactttgataaaatccacaatgtgtgtgtgtgtgtgtgtgtgtgtgtgtgtgtgtgtgtgtgtgcgctggtatatatatatttncgcnagtgcgnatgtgtgtgta

SEQ ID NO: 27730 - DNA, 473 bp, Homo sapiens
ggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagagaagaggggaaattttatttaaattgcatttattaatctttttatctgaaactttgtacacttttccactttcaaaacctattttaagtacagcaaaatttatttaaaactgtcatagcagtaaaaagtattacgatgaaattgttagggtattaatggaacaaacccagtttcactctcttgacacacttattaggaagggattgcttcactggtttaataatttaaaagtatggttttgttaaacaccctgtcagaacagtcattttcagt

SEQ ID NO: 27731 - DNA, 440 bp, Homo sapiens
  misc_feature 439: n = A,T,C or G
gttttctgaattacgtgggtagtgtacacctacatgtaagttaccttttaaatttttccggatccatctcactagagtgtagagcaggaagcctccttgcagcttctctgaactgatgtgtagagtatttttagactccttttcttgaactgggcaatgttttgaaggtctgcatttaaagtgatactatgtgtacttgaattttatagaaaaacaaagtttacctttattttcccatttggcatttctgcagcaaacttacttcttaccgtgactgctgcacagccttggccagctattccagatgttatgccttatttctgaatctaattaacaaataccagaagaagcaggtcagttcttcattcatttaattcttcaatgagtctttacactaatgtgtttgtgtaagcccatgttaaatgtctttatgtttttng

SEQ ID NO: 27732 - DNA, 200 bp, Homo sapiens
aggtactctgtaaatgtttaccttctctgcagtgcctgccacgtgcccgaagaaaagacacattaaaaagttaagtgacaccagtcctgattttatatattttatatacctaacaacgtatatgttagtatgtagaaattatatccttgacctttttccctacctattacgaactgtacttttattaaaagctgccactt

SEQ ID NO: 27733 - DNA, 472 bp, Homo sapiens
agtacagtctgccttttccctcctctttgttgatcatggtcactcacctacttgccagacagttcagacccgcagccacaggatttaatggatgggctaggctcagcaccaggatttgctgcaggtgcctctttgtattgttcttgggttttgagctgaacttaaagaggaatttcctcatcagagctcacactgcagtcatgttaaggctaatccagtttcacccccattctttcttgggggcagtggttggagttggggaaacctcaggatctggcttcaatatttttcttatcatacacagggactatgcattacatatttttactctctgagtgaagtgatagaaaacagaagtaggttctcaaacagttaattgattgatacgcttggtcacaatgctttttaatgggaaacctgggagagctgtgaggcattgtttaattttagtttcattaatgggaagctcttg

SEQ ID NO: 27734 - DNA, 299 bp, Homo sapiens
  misc_feature 12, 268: n = A,T,C or G
ggcattggagtnaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggagtaatgaagaagttagtactattattatctcccattttccagatgaggaaatttagttcctganggttgaggtagcttttgcagtttgggggaag

SEQ ID NO: 27735 - DNA, 113 bp, Homo sapiens
agatgattccattctccgattggccaaggccgatggcatcgtctcaaagaacttttgactggagagaatcacagatgtggaatatttgtcataaataaataatgaaaacctag

SEQ ID NO: 27736 - DNA, 181 bp, Homo sapiens
catcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 27737 - DNA, 469 bp, Homo sapiens
ggtagcagtgagaccccttgtcttggtgatccttactgggtttccaagcagaggagtcacatgattacaattgccagtagagttgttgtttggggtacaagatgagaagaaagaaaaacctacagcctttctacattctgacatgctaacagtggtttaagtttctaaagtgtttaccagatgctgaaggcaaggggagggagcagaagcacttatgtttacggatattttaaactctgttagagagcagtctttgaaaatccccaatttggttctgctttttgacctctctctaccttttcagggtaatctttgtggcacaaacgatagcatttccaagctttagagttttctgaattcctgcgccttcctgacgtgagccctgagcgatcttctatgcagttctgccatgcgtcctgttggtctctctgtgttctttgttacttgggtgcaatagcaacttccctac

SEQ ID NO: 27738 - DNA, 119 bp, Homo sapiens
  misc_feature 89: n = A,T,C or G
aaagcaactacacctggatttttccaaacaacttttatttcctcagagtcttccttaatcctatggaacaagaagctgccactgaatanggcccagtataggggcttgctttttctact

SEQ ID NO: 27739 - DNA, 174 bp, Homo sapiens
  misc_feature 1, 21, 80: n = A,T,C or G
nccggggaaatttcggccctntatggcccggggtcccagttactgtgggtgccaaagatacagcagtgaacaagagaganaaaatccttgctctcatagagcttgtattttactgagggaaggcaaaataaaaagtaaaatttatggtatgtcaaatagtgattgataaggcac

SEQ ID NO: 27740 - DNA, 500 bp, Homo sapiens
  misc_feature 12, 15, 28: n = A,T,C or G
ctccacagggcnttnggtgattatggtncggggggtggcccaggcgcgttaagctggttgggacccgggcaaggcctccctcttaaggtctttcccacacctctgcaccttgttacctgactttcggcttcaggatccgcagcgtgcacccgcgttccgcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggca

SEQ ID NO: 27741 - DNA, 163 bp, Homo sapiens
  misc_feature 3, 10: n = A,T,C or G
atntaaagtngttgctcaaaaagaaatcatagttgaattagtgagtatagtggggttccatgatttatcatgaattttaaagtatgcattattaaattgtaaaactccaaggtgatgttgtacctcttttgcttgccaaagtacagaatttgaattatcagcc

SEQ ID NO: 27742 - DNA, 347 bp, Homo sapiens
gaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacgatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactac

SEQ ID NO: 27743 - DNA, 314 bp, Homo sapiens
  misc_feature 312: n = A,T,C or G
atttcagtggaagttatttcccttcatctcattacagaaacaaaagaagattacaggccaggggatccatgaggtttcaagagaggctattgatgaatgaagttggaaggagttgatacacggtcagagatggttaacatccagaaattcttacaaagaaatggcaattctcttccattaatcctgtcttgcctctttgatcttgaatgataccatggctgcaagttaagtgcaaaacgaccctggtgttaaaggccttcaaagatcttgccctggagaaagattcttcaagaatttggaagattaaaaatnac

SEQ ID NO: 27744 - DNA, 468 bp, Homo sapiens
caatagagtcaaatgcagttaacatctgagtacacagattttgaatatgtctggcaagaaacaccttaataaagatgacaacttgacaacctcctacaatttattacataattaattgtggctattttttaaatatctagaacccaggaaccaggaaactccagtctgggcaacagagcaagactccatcttaaaaaaaaagaaatggaaaggacatagatttttcaaatccagtcaccaactttcaggacgatatttttatcccattatacgtatttattcagaatccattcttcacatgcttcccaagggcctcctaggtacaggcattgttctaggtttactcagcaatgaaaagcatagtcccacaccaggtgtggtggctcttgcctgtggtcccagcactttgggaggctgaggcagacgagtcacttgaggccgggagttcgagaccatcctgggcaatgt

SEQ ID NO: 27745 - DNA, 444 bp, Homo sapiens
gaaaaataaaagtaataaaagtatcttaaaaatagcataagaattttcatatttttaaacaaggcagttttgtagtcccttaagattaaatacaactgctcctttttttttaaactgaggccttgcgatattttgtgtgaatagatatgccctaggagttcagaaaaagttaaaagtatgttttctaattaaatgcagtgcacattcctggatcaatattcaaagactggtcataacctgctgtgttaaaataatcacatatgctctttttcatcagatttgttgatgatgtaaataaaatgtgtaaatatattagtaaatgttaatattcatgtattttaagttaaggttataaaatttgtcacaatgtgttttttattcaagtgaaaacagatgtgtgcagctattttgaatattgggtttataaacattcatattcttttt

SEQ ID NO: 27746 - DNA, 500 bp, Homo sapiens
  misc_feature 10, 20, 29, 33, 37, 51, 52, 59: n = A,T,C or G
actatctggngtcctgctgncggtaaacntacnggtntgtcgatctaaatnnaatcttnggatgtgatccgccttattatgcagtacttgaaggagaacagtttacatcgggcgttagccaccttgcaggaggagactactgtgtctctgaatactgtggacagcattgagagttttgtggctgacattaacagtggccattgggatactgtgttgcaggctatacagtctctgaaattgccagacaaaaccctcattgacctctatgaacaggttgttctggaattgatagagctccgtgaattgggtgctgccaggtcacttttgagacagactgatcccatgatcatgttaaaacaaacacagccagagcgatatattcatctggagaaccttttggccaggtcttactttgatcctcgtgaggcatacccagatggaagtagcaaagaaaagagaagagcagcaattgcccaggccttagctggcgaagtcagtgt

SEQ ID NO: 27747 - DNA, 472 bp, Homo sapiens
ggcccctctctgccttctctgcagtgggagcaggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgttttgggggcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgt

SEQ ID NO: 27748 - DNA, 369 bp, Homo sapiens
  misc_feature 6, 39: n = A,T,C or G
gcacancgggaacgggcacatccatctgccttccctagnagactagcaggatacagaactcgtgacagatataccttttaaggagactattttttaaaataaaggctttttcttcctgtgctatctctaataacgaggagcaatcattaaaagcgttcctgtaaagcgttatttaattttgtagttataatgaatagactagagagtaaaacatcttgagtgtatcatgagtaatttcgcagtggggacaggctctttggcagtgcacaaagtaataaaattcctgcttcatactatattggttctcttttcgtcttcatttaagttgttggatgtgatgtttccaggtacattcaaagtcccgaaatg

SEQ ID NO: 27749 - DNA, 172 bp, Homo sapiens
  misc_feature 16: n = A,T,C or G
gagaaactaaaaagtntccactcctatttatttatttgtttaactttcatgacttataaaagactgtatttcttcattgtagcaatggttcaccacaaattctgcaggaagttaagcatagtcttttaaatatttttgctatcccttttccaactagagggcaacactccat

SEQ ID NO: 27750 - DNA, 357 bp, Homo sapiens
ggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaggataattacaaagcttatcacatccaaaagaattatcaataattttgaaatattattaaacgtgtaataaatgttcaaagttct

SEQ ID NO: 27751 - DNA, 489 bp, Homo sapiens
  misc_feature 30: n = A,T,C or G
tgaacaaagaacccagtctcaaaaatattntccatccatactatcatccgtactctgggtcccaggaacatgtttgccagtcatcttctaagcttcatttacatgaaaataaattagactgcgacaatgataacaaactaggcattggacatatttttagtacagataacaactttcataatgatgcaagcactaagaaagcaaggaacccagaagtggttacggttgaaatgaaagaagaccaagagtttgatttgcaaatgacaaaaaatatgaaccaaaatagtgacagtggcagtacaaataactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaaaatgttcaacttcataaag

SEQ ID NO: 27752 - DNA, 397 bp, Homo sapiens
  misc_feature 5, 396: n = A,T,C or G
agggnaagcaaactaaaacccaatgacagggtgatgtcagcgaaaatggtagagtaggacttctgtgggccatccctctgcagaaacaccaaacaccttgacagaaaagtcagaatttagcttatcaaaactctggaaaggtaatcaaaggtttacagcagccaagcaaatacttcgccagaagaaagggcactgaaacaaggtaagagatctttgtggcatttagcttaccctagcctcacctcccttcctggtatggctgcagtcttgaagatgacagcctgtgttccccatgctggtgcctgattccagagagtggacactcttcctcctgagggattctgtgttctgttttgtcctttctccaaaggactgccaccaggggcaaaaaacaanc

SEQ ID NO: 27753 - DNA, 470 bp, Homo sapiens
  misc_feature 5: n = A,T,C or G
aatcnggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaag

SEQ ID NO: 27754 - DNA, 384 bp, Homo sapiens
  misc_feature 6, 379: n = A,T,C or G
ataccngtcatcacacaagatcaacttcttcgtttaaatgacacaaatccatattgtggaaggaaaatatgtagtgccttagcttcactaatagttgtaaaacttctttttaagacatcaaaggctagaggattcattttatgcagtgcgaacatctaataacactctctgtgtcaaatatatattgtacattaccttaaactattgtaatagctaggtaaaaatccttgtataaaagaatgttttcccccacacaaagggcagagtattgagcactaatttcctattaaaagtatatatatgtatctgtgggtcactggtgtccagacttgtatttgcatttgtgtttacttgaggaacttgaacactaacaactggnaaaat

SEQ ID NO: 27755 - DNA, 266 bp, Homo sapiens
atcaacaaataggaaattcttaacaataaatctgacaaaatatgcaatatgccctatgtagtgaaaactaactattgctgaggaaattaatcaagagctaagtaggtggagagacacatacacagtgttcagtggaagacttaatgttgttaagatgccagttctccccaagtggatgtatacattcagcacaatctcattgtaaatccctgatgtcttttatcatagagatggacaaactgatcctaaagttcatatgggaatgc

SEQ ID NO: 27756 - DNA, 173 bp, Homo sapiens
  misc_feature 5: n = A,T,C or G
ggaanagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaatt

SEQ ID NO: 27757 - DNA, 128 bp, Homo sapiens
  misc_feature 34: n = A,T,C or G
catttcttatgtattgttttactcctttttattntacgtaaaattttggattaatttgtgaaaatgtaattataagctgagaccggtggctctcttcttaaaagcaccatattaaatcctggaaaact

SEQ ID NO: 27758 - DNA, 203 bp, Homo sapiens
  misc_feature 31: n = A,T,C or G
cagaaaaatggtggtgattttctcctgtggntggggagtttagtattatgaggacatgttaatgatctaaaggtaacaagcagttgctggttccagtttgccccagccttgagctgatttattgtcctttggtaactggggaagggtcctgaagctcctgcagccccctggggcatctggagttcttttaagcaaacacaccg

SEQ ID NO: 27759 - DNA, 424 bp, Homo sapiens
  misc_feature 10: n = A,T,C or G
atctctaagnactgcttcttgcttttctagacagttttcactctggaaaggaaaccccactaacagtcctgtgttatttgttgcttgtatatacaggtgtcccatgtcttaacatggtcattaagtactgaaaggaaatgaggcatgaggtaggggtaggagtcatgaactagttattaatgtaggaattaaccttgcttctgttgataacctgtatgatcttgggctagtcaccaagcctctctagaccttctacttatgtctcctaattgaggacgttggactagatcgtctctaaggtcacctctgagtagaaatttgaattgtcctgtttttgataaaaatttttatcattgtcaaactaagcaaatacttttggtggaacttgtaagaaaactttaaacaaatttttaaaaagtcttct

SEQ ID NO: 27760 - DNA, 471 bp, Homo sapiens
ggaacccagcttgcagccgcctgacctgggagtcctgtaacaacactgaccaaccacacagcaaagccagtggtcctgtccagagagagaaccaagccaatgaccccacccaactgcagcgtacatcttgcagccctgcttcatcatgcagcccaatgtgcagccctgcctgagcaaggagtccaaccagcagcaatatttgaccagagagcctatcctggatgccccccaactgtggatgattatgaagcctacctgcagcccaactgcaaagcctaacacatggcagcacatggccaatgagcatagcctgtgatcctgcccaacaggaagcaattctagagcctagccagcagccctgtctgactgcagagcccaaccagtggccccacctgaccttagcagtatgggcagcagccctgcccagctagagaacctgacagcaagtactgcctgcctacccatggatgt

SEQ ID NO: 27761 - DNA, 386 bp, Homo sapiens
  misc_feature 6, 33: n = A,T,C or G
gacttncgattaggacatgagaagtatttgttngcacctataggcagacttagatgcaatgttttactttgatgccaaaagtgggggaaggccttagaccaatagcatggcgtttgttattttagtttaccattctccctccaaacggcccatttcactgagactggggctatcttgctgcagcttggagtcaaacacacatggatgtgactctgcctttgcctctcagagcctcagtttcctcatctataaaatgaggctaatagtacccagctgatagggctattgagaggatcacatgaaataacatatcagatgttcttattacagtggttaggtacagagtaaatacagaataaggggtagcctttattatgaggatttat

SEQ ID NO: 27762 - DNA, 137 bp, Homo sapiens
cccagtaggggtttctgcatctcacctgtatagtagttatatgcatatgtttctgtgcatgttctctacacaattgtaaggtgtcactgtatttaactgttgcacttgtcaactttcaataaagcatataaatgttg

SEQ ID NO: 27763 - DNA, 397 bp, Homo sapiens
  misc_feature 32: n = A,T,C or G
gagtgacggtggcgtttccttgaggaagagtnagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcat

SEQ ID NO: 27764 - DNA, 122 bp, Homo sapiens
tattgctattgttatctctgtcttctctttgcaataaataatcattatttactatggccaccctgttgtgcaaagatttcaaaaactattctcctatgtgaaatttgttcccttttcttttc

SEQ ID NO: 27765 - DNA, 312 bp, Homo sapiens
  misc_feature 1, 2: n = A,T,C or G
nncgactggaagggactactgatgttctgtgatacatcggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctcg

SEQ ID NO: 27766 - DNA, 263 bp, Homo sapiens
  misc_feature 7: n = A,T,C or G
gtttaantgttgtacttgaaaaggtcaatcttcagggcttcctgtttgaagtcaagtcagaggtaaaccggtcagttacagaagcaggatttctaggatttctaactccagctgttcccatactgtctagtttaaattatggctgttaaggccgggcgggtgactcaggcaggtaatcccagaactttgggaggcccagacagaaggatcgcttgaggtcaggaatttgagacctggccaacatggtgaaaccctgtctctac

SEQ ID NO: 27767 - DNA, 488 bp, Homo sapiens
  misc_feature 7, 25: n = A,T,C or G
aaagacngctttagcatctccaaanagtgagtggtggggatcagcccagcacaaaacctgggtctcttttcccatgactgtaccttggggtcccaggtcactcttgttcaacttagctcaaggttcaagtgcttccagaaggactgcagatagtggccagtcttcacgggtgacccacgattgtcttgcaccacaatcaggaactacaggttgttaaaaagaccacggatcggccaggtgcagtggctcatgcctgtaatcccagcactttgggaggccaaggcggatggattgcctgaggtcaggagttcgaaaccagcctaatcaatatggtgaaaccccatctctactaaaaatacaaaaattagcttggtgtggtggcgcacccctgtggtcctagctactcgggaggctgaggcaggagaactgtttgaacccaggaggcggaggttgcagtgagccgagattgttgcactgcactccagcct

SEQ ID NO: 27768 - DNA, 489 bp, Homo sapiens
agagtccaaaaggagggttgggggaagaatttgggtaggaagtccctgggcagcacgactagagagcctgtcttaaggagtctttatgaagtggctttgctttccctgaggcatgttgcccactcacttcaactcctaaggtttttatcaccagatattctctcccagaccccagctgatgatgaaggtagcctcatagaggggactttccctggttcaatgatgagggaagaacagacccctaagcccccaggtgaccacactgccctggatgctggatgaggctctgacattgtggccttgagcaagtcccttctctccatgctgacctctaataagtccagtacaaagtgtgaacctgggtcaggcgcggtggctcacgcctgtaatcccagcactttgggaggccgagtagggaggatcacttgagctcaggagttcgagaccagtctgggcaacgtggcaaaaccttgtctctggaaaatatac

SEQ ID NO: 27769 - DNA, 490 bp, Homo sapiens
  misc_feature 7: n = A,T,C or G
ggctgcngtggcttcgtcttcggtttttcttttccttcgctaacgcctcccggctctcgtcagcctcccgccggccgtctccttaacaccgaacaccatgccttcaattaagttgcagagttctgatggagagatatttgaagttgatgtggaaattgccaaacaatcggtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttgcatgcaagactgttgccaatacgatcaaggggaaaact

SEQ ID NO: 27770 - DNA, 466 bp, Homo sapiens
  misc_feature 7: n = A,T,C or G
agtgaanatatctctttgatacactgatttcaattcctttgaatatatatgcagaagtgggattgctggataatatggtaattaaaattttagttttttgaggggcctccatactcttttccaaaatggctgtactaatttacattcccaccaacaatgttcaaggatttcatattcttgacattcttaccaaaattgtcacagtttgtaaaaggtagtctaataagtggcctaagtgaatgtgacaacacttcattgaaagcaatcttaggtttttccaactatagtcaataataacttaattgtacattctaaaataactcaaagagtgtaattggattgcttgtaacttaaaggataaatgcttgaggggatggatgcctcattctccatgatgtgcttatttcacattgcatgcctgtatcaaaacattacatttatcccataatatacacacttactatgt

SEQ ID NO: 27771 - DNA, 409 bp, Homo sapiens
  misc_feature 13, 32: n = A,T,C or G
gatgtctcttgtnagctgtctttcagaagtanctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaataccac

SEQ ID NO: 27772 - DNA, 154 bp, Homo sapiens
gacctcaaacataagcctacctgttcatggccatgttactctgaaactgggttcaaaagccagttttaaaagattttccctcctcttgtttaactatccttggttacatgcttctcaggactagcatgatgtgcgttatccagcatccgggagc

SEQ ID NO: 27773 - DNA, 404 bp, Homo sapiens
  misc_feature 31, 37: n = A,T,C or G
atctccaagtctatgtattttctggagaccnaaccgnataccagataatcacaaagaaagcttttttaataaggcttaaaccaagaccttgtctagatatttttggtttgttgccaaggtagcactgtgagaaatctcacttggatgttatgtaaggggtgagacacaacagtctgactatgagtgaggaaaatatctgggtcttttcgtcagtttggtgcaattgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttgg

SEQ ID NO: 27774 - DNA, 273 bp, Homo sapiens
  misc_feature 5, 7: n = A,T,C or G
aaagnanccaggaatgaaagtggcgctttcttcgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttt

SEQ ID NO: 27775 - DNA, 107 bp, Homo sapiens
ggggggaatacagtcatgggttctttgtttccggttgggctggtaaagccctttcctcatccctcttttcactagagacaaactaaaaaccatggctttaagctgcc

SEQ ID NO: 27776 - DNA, 253 bp, Homo sapiens
  misc_feature 32, 33: n = A,T,C or G
aatctacggtgataagtacttgaaactccacnntgaaaaggaagtatatttgaggtgttcaatctaaatcttgaagcatatgaggaaaaagctccaactgtcctaattttaaggtgattctaatagtctgtagaagttttaaatttttgtgtttacaaaaagctagtaacagctaactcacctattccaaatattataacggtcggaaagccagccatcataaaaattacttttcagccagctagttttcaca

SEQ ID NO: 27777 - DNA, 484 bp, Homo sapiens
  misc_feature 56: n = A,T,C or G
gggacatttgacttagaattgtatataattaaaatatagatgaaaaattgtataantttatagctatctgaaaacaacttttttttaatatttgaacactttgaaatgccttacacttccttgttaaaaatcttaaagggatattaaaattaaatggcacttaattactattagtaattcctaatataatatttaattcataaaagaaaaaagcttaatgttgaattctggcactcatcgggaagatgacattatatgttaagagataatttgtggggcatagtaactatagttaatattgcatacttgaaagttgctaggagagtacattttaagtgttcacaccacaaaatataactatgtgaggtaatgcatgtgttaattagctagatttaaccattgcataatttatatgtatttcaaaatgtgttgtacaccataaatatatacaatttgtatttatcagtttaagaagaagaagaag

SEQ ID NO: 27778 - DNA, 210 bp, Homo sapiens
  misc_feature 32, 210: n = A,T,C or G
attgtcactactcagtagacaggcctaggtangagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctn

SEQ ID NO: 27779 - DNA, 366 bp, Homo sapiens
agctccaataaaaaataattccactatcttactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgatt

SEQ ID NO: 27780 - DNA, 486 bp, Homo sapiens
  misc_feature 6, 8: n = A,T,C or G
aacctncncaggtcttctacctgcgacgctttttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattg

SEQ ID NO: 27781 - DNA, 154 bp, Homo sapiens
  misc_feature 30: n = A,T,C or G
ctgaacagtgtgtgtggctatgtgtacacncttttgtgtgcatgtgtatgtcttggaattacatttttactccagcacagaaagatgattatagaatcataagttgactacctttgcttaacaccaaattaccttttgatgtacacatgcagct

SEQ ID NO: 27782 - DNA, 121 bp, Homo sapiens
  misc_feature 6: n = A,T,C or G
attganagaacaacttctttcgctaaaagtgacctgagaaatttttattatttgagagtagccatataaacgttatgggattttcttgagattctaaccttggacagaggcagaactatcc

SEQ ID NO: 27783 - DNA, 284 bp, Homo sapiens
  misc_feature 5: n = A,T,C or G
gtttnccgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacat

SEQ ID NO: 27784 - DNA, 278 bp, Homo sapiens
ggctgcgtgtggtggctcacatctgtaatttcgcactttgggaggctaaggcaggtggatcagttgaagtcagcagttcaagaccagcctggccaatatggtgaaacaccatctctactaaaaatacaaaaactagccaggtgtggtagcacacacctgtaataccagctacttaggcggctgaggcaggagaattgcttgaacccaggaggtggaggttgcattgagcggagatcatgtcactgcactccagcctgggtgacagagtgagacctcat

SEQ ID NO: 27785 - DNA, 390 bp, Homo sapiens
  misc_feature 7, 19, 34, 50, 53, 102: n = A,T,C or G
aaagaanagactaaaatanccaaacgacgctggncgcatgcgctggctgnggnctgtctgctgaatgtctatttttgtctcctgacgagacgtgaggaccantgcccttgatccctccgatggaccagaaacccccttccttgcaaaaaaaaggcaattgaattaggaaaagatagaccaacctagctcagatccaccaagataagcacagcaaagcttggctgcatttttgaggaataaaaacctgcagaaagcactgataaccttcaagatctgaatgagattctattataacccgtctaaacgattgcaaaattcctcctttggttttggaagcagcgtttgctctcccgtggctcggattctctgaggaccagggagttgacacgc

SEQ ID NO: 27786 - DNA, 268 bp, Homo sapiens
  misc_feature 7, 31: n = A,T,C or G
caaggcncatttttccaacttctctaatganttattacatttctgagtagctgatatgtttttatcttatctaagcagtatatttataattccttctttgcattggctaatctgattagtagttcagaacccaattttcagattgtctatagcaaactgtgaagaactgtgctgtcaaatagaaatagaatataagccacatatgtaatttaaacttttctaataccacattaaaaactataaaaggggaggaaatggaaaattagtt

SEQ ID NO: 27787 - DNA, 178 bp, Homo sapiens
  misc_feature 32, 115, 117, 131: n = A,T,C or G
agctcactgcagcctcggtctcctagggtcangtgatcctcccatcttagcctcctgagtagctgggcatgtgccaccacgcctggctactttttaaatttttttttttctgtananacgaggtctttctntgctgttcaggctgaacttcatgggtttattggggatggctaatgga

SEQ ID NO: 27788 - DNA, 119 bp, Homo sapiens
aacaacgtaaaaataaaatgacagtttgaacatacaaaacccaccccattcctccccacactcatcacccttaccacgctactcctacctatctccccttttatactaataatcttatg

SEQ ID NO: 27789 - DNA, 144 bp, Homo sapiens
  misc_feature 6, 31: n = A,T,C or G
cttccngatttgcaagaaccaaattgctcancagtatgtatgtttagaggggttagactcctttttaaaatctggatatctaaccacctacttaaatctgtttgatagtgtcaaaccacccccacccttgatcctcccaccccc

SEQ ID NO: 27790 - DNA, 286 bp, Homo sapiens
agagacaggattttactatgttgcccaggctggccttgaactcctgggctcaagtgatccacctgccttgacttcccaaagtgctaggattacagatgtgagctaccatgccccatctctactaaaaatataaaaattagccggacatggtggcaggtgcctgtaatcccagctactagggaggctaaggcagcagaatctcttgaacccgagaggcggaggttgcagtgagctgaaatcatgccactgcactccagcctgagcaacagagtgagattctgtctcc

SEQ ID NO: 27791 - DNA, 500 bp, Homo sapiens
  misc_feature 6, 12, 33, 34, 36, 37, 44, 45, 48, 49, 55, 63, 64, 65, 67,68, 72, 73, 74, 80: n = A,T,C or G
agtctntacgcnagtagagcttaatgacatgcnnannatccaanngcnnactggnaccttagnnntnngccnnntctggntacaagccactactgtctttctctaagagcactgctgtggcctcctctcagatctacttgctttcacccctcccctcttaggtctgttttctacatagcatagcaacagcgaattcattggaactatatcaatcactgctctgttcagagccctgtaatggctcctctttgttcttagagtaaaagccaaaatcttagagtgaccatcaagacctccgtgagctggggcctcgttggttcttgaatctgatcttctacactcttctttgctcactctgcaccagccacaggactaccagaagcacatagtagctaagtcctctgtctggagtatgctttctccagatacccatatgactaattccctcacttccttaaaacttttgtcaaatgtcaccttctcaatgagacttaccctga

SEQ ID NO: 27792 - DNA, 459 bp, Homo sapiens
caccatcgttggtttgttcttcagttaagttagagctctgtcctctttctttcgagaaatgttgtaagaaagaatagagtgatggctctgaagtgtcacacttttcagaagaggcttcagtttaaaccattctttgagattgttccagtattggcacatttttacccattggttgaaagggcccattctcttccatatcctctgtactttctgtgttttttctccataaatacattttacttgactgtaatgaggtctcatgatcagaaaggcatatgaccgtaacactccagctttctggacaggatactttcttgatattttgagggttatttcacactcccctctgctgtgcttttgtggccctttttgctcatgatagctgaaatggaataggggatttcttatagatcatctttaagggcagcgttgggatctcactggtatcccagctatagg

SEQ ID NO: 27793 - DNA, 489 bp, Homo sapiens
  misc_feature 30, 55: n = A,T,C or G
aactcaattgtaccaaaacaatgatttacnccaataggctgtgatgggctggttntcccatactctcagtagcactagatattatcattctttgagcatcttttcatatgtattggtcattcaggcttctcttctgtgaattagctttttttgtttttgcttttgtttctgttttaactaggttgtctttttctaattaaattataattatgtattttaggtattaatgttttcttaatatgttgcaaggccttcatgatcctgggattacttaggttcctgtatttccttatgttgtgcatttatcattgagatactaatctatctggaatttatttgtaggtatgacatgaggcaaaatctaacttattttccgtatggatactttaattttctatcacagtgatttgggtatctgttttacattctttttccacttatttgaaatgtgaactatgtcatatactaaacatatgagagatttgttac

SEQ ID NO: 27794 - DNA, 458 bp, Homo sapiens
  misc_feature 7, 22: n = A,T,C or G
ggcttcngaatatcttcccagnaggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgaga

SEQ ID NO: 27795 - DNA, 488 bp, Homo sapiens
ggtcaccctgagtttatattcttatcctaccggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcatttcactgatttcccctattctca

SEQ ID NO: 27796 - DNA, 395 bp, Homo sapiens
  misc_feature 7, 273, 382: n = A,T,C or G
cagcccntttctctctctcttcctcaccacacacagacacacacacacacacgcatgcacacacacacacttcagtgaatgtattttgagtaatggtcaaaatatcaaaataatgtagttgcaatgcatatgtctcttaagcctcttttaatccacaggttctccattaatattttttcatgacactttgtaaaaaatatagatcaccagcctgggcaacatagtgagacactgtttctacaaaaaattaaaaaattagctgggtgtggtggngcacacctgtagtcccagctactcgggaagctggagtgggaagattgcttgagtacaggagttcaagtttgcagggagccaagattctgccattgcattacagcctggntgacagagcaaga

SEQ ID NO: 27797 - DNA, 490 bp, Homo sapiens
  misc_feature 7: n = A,T,C or G
ggggccntgtgttaccattaccactttgattcagcatgaatcagaaccccaaaacaggaagagttcacttatcttcaacagctaccttaccaccctcttctctagcaaagaaaaaaacgaagaatgaagagctttggctagtaccaagaactgaatctgctggagatgtttataaaatataaataaatatatttataatacatacaatgcatcttagtggaactattaagaaaaagaaaaataccgaaagataaaaggatatataaaaattttcttgccaggcatggtggctcatgcctataatcccagcactttgggaggtccaggcgggtggatcacttgaggtcgggagttcgagacacctggccaacatggtgaaaccccatctctactggaaatacaaaaattaacctagtgtgatggtgcgtgcctgtggtctcagcttcttgggaggctgaggcacaagaactgctggaactcgggaggtgca

SEQ ID NO: 27798 - DNA, 464 bp, Homo sapiens
gattgctttttgaaaagctaaatgcttaaaatgcttctagagggaagtcgtggggcgtgtgctcattctctttaaaatcagggttgttgagtttgtttttaaacatttttataagttcatgagaaaaaatatataaattctaagaaccaacactgtattcccagaaacatgaccctcgctggtcttgggtccacatatcattggactctgggggacacaaagatgcctgtgacactttggtgttgccgagttagtcaacaattattctgggaaaaagcagaattgaattcttctctagatgtcctaccagggttggccaagggccacaaagcaggctaataaattcccacaggatccagacaccaggcaaaattgctctaagaagccagttactgtcatccctctatggttctagaaaaaatagtacaaaaaatgacaggtcatcctatgagcgtcatgccaat

SEQ ID NO: 27799 - DNA, 169 bp, Homo sapiens
  misc_feature 32: n = A,T,C or G
gatgattactggtctgtggaccccttggacanggccatggctgagctggctgcctgaggaggggcagggcccacccatgtcaccggtcagtgccttttggaactgtccttccctcaaagaggccttagagcgagcagagcagctctgctatgagtgtgtgtgtgtgtgt

SEQ ID NO: 27800 - DNA, 448 bp, Homo sapiens
  misc_feature 446: n = A,T,C or G
gcatgcgcttgtatatgtaaaatcctaagtaaattcactgaaacctattatcaccaataaataagtttatcaatgtggcaggatatacaaaatcaattttatttctatatgctaacattaaggaatccaaaactcaagttacagaacgatttctgtttacagttagcattgaaaaaatctttgaaataaatttagcaaaatagtacaagacttttacaatggaaactataaaatattgttgaaattaaagaagacctaaatatattggaagacgttccacgtttaaggatcagaagacttaatattattaagatggcaatattctttgaattgcactagattcgatacagtccttatcaaaatttcagctttgccaaaattgacagtctgatgctaaaattcgtatagaaacgcaagagtcccagaatagccaaaacagttctttntt

SEQ ID NO: 27801 - DNA, 119 bp, Homo sapiens
agttcctaaaatctagtatgacgactgtaccctgaccactttggggattaaggtttaattagaaatatgtatggtcagtcaacagttagaaaattggaataaaacttaaaaatgttggg

SEQ ID NO: 27802 - DNA, 325 bp, Homo sapiens
  misc_feature 31, 324: n = A,T,C or G
caatccgtgaatgtaaaaactacactgttgntcttgctaggatccaccctcctataatatggaacaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccnt

SEQ ID NO: 27803 - DNA, 282 bp, Homo sapiens
atacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaaagc

SEQ ID NO: 27804 - DNA, 184 bp, Homo sapiens
  misc_feature 6, 33: n = A,T,C or G
ggtganaccctacctctacagaaaaatacaaanattagccgggagtggtggcatgcacccgtagtccctgctacttgggagactgaggcaggagaattgcttgaaccggggaggtggaggttgcagtgagtcaagattgcgccactgcactccagccagggcaacagagtgagactgttgtccc

SEQ ID NO: 27805 - DNA, 480 bp, Homo sapiens
  misc_feature 12, 25: n = A,T,C or G
accaaccccagnatggctgcacagnaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataatttttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaaga

SEQ ID NO: 27806 - DNA, 434 bp, Homo sapiens
gattcctgagctgacagcattcgggccgatatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcattatggaggtttgaagatgccgcatttggattggatga

SEQ ID NO: 27807 - DNA, 242 bp, Homo sapiens
  misc_feature 6: n = A,T,C or G
atccgnatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaaga

SEQ ID NO: 27808 - DNA, 379 bp, Homo sapiens
ctgcttgtagttcaagagccctacaaatagggtgaggatgtttgtggcctagttttgtggaggggaatgaggcagagtggtagaatagaaaggagtgcagttcgggaggtatgaaaagaaatatattgagaaaaatgctaactcttatgtgatatgtatttcctcaaatcactttctaaatgaaatagttgattggaggaagagagcagtaaacatgtccatataccatatgtagtaatctgatataaagagattaaatcttttgcctaattatatctcttccttcagatccctttagaagtacattttcagtcaaaaggatggtttgaattgtttccaagcttaggcttatatttaaaactgtagggttgacttgaga

SEQ ID NO: 27809 - DNA, 297 bp, Homo sapiens
  misc_feature 294: n = A,T,C or G
aaataaattcacaatgttctgtagccattaccactatctgtgccaaaactttttcatccccaacatgaactctgtacccattaaacagtaactttctcttcttccttttcttacttcctcgtaagttcttgttttttgttgtttttgtctctgaatttgagaaggctgaaattttgtcgctttatagtttgcaactatatttctagtgctaggaattgtgcctaacactcactctaacaaatatttgttaaattgactgaatgcatggtagataagcttgagggaatcacacangac

SEQ ID NO: 27810 - DNA, 213 bp, Homo sapiens
  misc_feature 39, 63, 65, 95: n = A,T,C or G
ccgtttcaacagagaggcttatttgactttatgctatangatgaggcttctgggataggcccngnagttcctgatgaccgcgacttcgagccctncctaggcccagtgtgccccttccgctgtcaatgccatcttcgagtggtccagtgttctgatttgggtctggacaaagtgccaaaggatcttccccctgacacaactctgctagacctg

SEQ ID NO: 27811 - DNA, 490 bp, Homo sapiens
  misc_feature 15, 21: n = A,T,C or G
gaaatgcccctcagnaaaatntctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccatt

SEQ ID NO: 27812 - DNA, 235 bp, Homo sapiens
  misc_feature 32: n = A,T,C or G
attcccggactgactgatactacagtgccttnccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgta

SEQ ID NO: 27813 - DNA, 234 bp, Homo sapiens
  misc_feature 6: n = A,T,C or G
ctcctntatcagactcatctatttttgtttttcagaacttttcacgtggaaaatgtggtaaacttttagagtctttgcatgtttaaaaatttctatattttgctctgtcaattcattgatagttgactgggtattcaaattgtttacctgaagaattttgagagcattttctggactgcttttaaataaatttcagatattattttatccttaaatactttagtatgtgtcttc

SEQ ID NO: 27814 - DNA, 488 bp, Homo sapiens
  misc_feature 16, 31: n = A,T,C or G
atggacactggcgagnacttgcgtctacccnttccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgt

SEQ ID NO: 27815 - DNA, 214 bp, Homo sapiens
  misc_feature 5, 29, 30, 213, 214: n = A,T,C or G
gcgcncttcggcaccttttcctgtctcanntatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagcnn

SEQ ID NO: 27816 - DNA, 220 bp, Homo sapiens
gaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctgccaatgacagatgcaagcccaacacccttttggtacgcaaaacctgctctcaataaattcccccaaagctccg

SEQ ID NO: 27817 - DNA, 375 bp, Homo sapiens
aagacaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttggt

SEQ ID NO: 27818 - DNA, 425 bp, Homo sapiens
ctacgaaatatgaagagcaaaagctgattttgcttacttgctaaactgctgggaaagctctgtagagcatggttccagtgaggccaagattgaaatttgatactaaaaaggccacctagctttttgcagataacaaacaagaaagctattccaagactcagatgatgccaactgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattg

SEQ ID NO: 27819 - DNA, 376 bp, Homo sapiens
atcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcgtcagaggctcttgagctggtgtttgtttagggcattgcctctgtcctgaagataaaaggattctattaacagcattgacattgattttttaatgaaatgagatatatcttttcataaccagctgcgtttttttcccctaacat

SEQ ID NO: 27820 - DNA, 122 bp, Homo sapiens
  misc_feature 6: n = A,T,C or G
ctggangcatttgtttctactttgatatgactgtttttcggacagtttatttgttgagagtgtgaccaaaagttacatgtttgcacctttctagttgaaaataaagtgtatattttttctat

SEQ ID NO: 27821 - DNA, 206 bp, Homo sapiens
tagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcc

SEQ ID NO: 27822 - DNA, 341 bp, Homo sapiens
gggggaagggaggtgactccggcggaagatgacaaggcagaatgcaggcccttcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctctc

SEQ ID NO: 27823 - DNA, 489 bp, Homo sapiens
gaaacggagtgctacccatgttctcatccttcagaagaatcctgcgaacggagcttcagtaatatatcgtggccttcacatgtgaggaagctacttaacactagttactctcacaatgaaggacctggaatgaaaaatctgtgtctaaacaagtcctctttagattttagtgcaaatccagagccagcgtcggttgcctcgagtaattctttcatgggtacctttggaaaagctctcaggagacctcacctagatgcctattcaagctttggacagccatcagattgtcagccaagagccttttatttgaaagctcattcttccccagacttggactctgggtcagaggaagatgggaaagaaaggacagattttcaggaagaaaatcacatttgtacctttaaacagactttagaaaactacaggactccaaattttcagtcttatgacttggacacatagactgaatgagaccaaaggaaaagctta

SEQ ID NO: 27824 - DNA, 489 bp, Homo sapiens
  misc_feature 31: n = A,T,C or G
aatttcatgtaggggttccaatatagtgaantataatgtcttgatctctacaagcttaataaaggcagccaattaaattttaagacttagcacagtggctcatgcctgtaatcttagcactttgtctcccaggttggagtgcagtcacagctcactgcagccttaaactcctgggctcaagcgattctcctgcctcagcttcctaagtagctaggactacaggcacatgacaccacatctggctattttaaaattttttttgtagaattgagggtctcactgtgttgcctaggctagtctcaaactcctggcctcgagatgctcctgcctcagcctcccaaagtgctggaattatagccatgagccacagtgcctggcctgagcttccttttaatgggctttttccccttttgtatataaccatttgtatatcaaaatgaggcactatctcaagtggttacagttgctctcttggttctattctgagta

SEQ ID NO: 27825 - DNA, 238 bp, Homo sapiens
  misc_feature 7: n = A,T,C or G
gcagggnaggcgaatcgctcgagccctcaagtttgagaccagcctgggcaacatgacaaaaccccgtccctacaaaaaaaataaaaaaattagctggtgtggtggcataagcctgtagtcttagccactcgggaggttgaggtaggaggatcacttgagcctgggtgatcaaggctgcagtgagctgagatcgctccactgtactccagcctgggcaacagagtgagaccctgtctcc

SEQ ID NO: 27826 - DNA, 236 bp, Homo sapiens
gaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgag

SEQ ID NO: 27827 - DNA, 462 bp, Homo sapiens
aacaatccccttactggatatatacccaaaggaatataaatcattccatcataatgacacatgcatgtatatgttcattgcagccctatttacaacagcaaagacatggaatcagcctaaatgcccatcgatgatagactggataaagaaaatgtggtacatatgcactacgaaatactatgcagccataaaaaagaacaagattatgtcctttgcaggaacatggatggagctggatgctgttacccttagcaaactaacatgggaacagaaaaccaaataccacatgttcttataagtgggagctaaatgatgagaacacatggacacatagaggggaacacagacaccagggcctaccagagagtggagggtgcaaagaaggaggggatcaggaaaaataactaatgagtcctaggtttaatacctggatgatgaaataatctataaagcaaacccctg

SEQ ID NO: 27828 - DNA, 472 bp, Homo sapiens
gatttccccagggtgagaatgaagcataacaatggagtagaagcatttcctttcactttagttgacatgtggaaatccatggattatacaactaggaaagaacagtagagcttcctggagaagaggaggccctcctcaggaaaccctcctattctgtctcagccctagagctggaagtttttcctagattgctctgattgggatatttttgtttccacagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcagtaagtagctttcatatctagttcagtgatagcagactggaaaataagcatctatacgcccagctctgcccttgaataat

SEQ ID NO: 27829 - DNA, 194 bp, Homo sapiens
atactacatcattacaaaagccctaagtctcatcttaacaacatgccttgctccaatcataagtgtttggtgtacacatgcatataaaatattatcctaaggtggggcgcagtggaacccgggaggcagaggttgcagtgagccgagattgtgccactgcactccagcctgggtgacacagtgagtctccgtct

SEQ ID NO: 27830 - DNA, 107 bp, Homo sapiens
  misc_feature 5, 17, 28: n = A,T,C or G
ggtcnactgtccttagnactgatgagcntggaggagtcaactaatgaagaaatgaataataaattttgacactgaaaaacattttattaataaagaatattgacatg

SEQ ID NO: 27831 - DNA, 375 bp, Homo sapiens
  misc_feature 6: n = A,T,C or G
gggaangaggcaaaagcccctgcttcttactttgtgatgtatgtggatttgttatttatttttttttccttggtcggacgttcataaatatgtactattttaattatgtcgagtgtaaatttgacatcgcgttgcatttatttttatatttctgaaaactgttgctttttctttttccctcccccattgacgacatagcggcccccgcgtccgggttacaaatacatctacagatattttcagggattgcttcagatgaaaacaaatcacacaccgtttcccaaaccaacagtcttcacatttctatccctctgttattgtcggcaggcggtgaggggtagaaaaaaaacaaacaaacaaacagaaaaaaaaacc

SEQ ID NO: 27832 - DNA, 141 bp, Homo sapiens
  misc_feature 6: n = A,T,C or G
agggtnaaaaatatttctaatgaaacattaattaggtttctttccttgttaaactaatttttttttgtttttctaaaatagataagtaatggaacatcatctgtgatcgtctccagaaagaggccatcagaaggaaactat

SEQ ID NO: 27833 - DNA, 342 bp, Homo sapiens
  misc_feature 6, 32: n = A,T,C or G
tgctgnacttattttagctaacccgagtccanttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgct

SEQ ID NO: 27834 - DNA, 464 bp, Homo sapiens
cagtgcggtaacgcgaccgatcccgcaagtatccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccg

SEQ ID NO: 27835 - DNA, 473 bp, Homo sapiens
caaattgaaaagctctggacagaagtcaatgccttgaaggaaattcaagccctgcagacagtctgtctccgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatagtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctcaataggtctttctccaatgtgt

SEQ ID NO: 27836 - DNA, 490 bp, Homo sapiens
  misc_feature 7: n = A,T,C or G
attgccngagtagacagtgggctacattagatgactgcttagacgcatgcttattctagaaaaggctgaaggaagaaagaaccaccccttcccctcctcttctcagctcccttctgctgggagcacctggctgccagttcccaagttcctctccatggggaattgcagctccaaggtggcctcctggagctgcctaactccgccttcactgaaaataaggtgattgaactgtaaagctgaaatcctctgcagtcatgtctcctccagagtcttcaaggtcactcccactttttttctagacacaaatggggtcatttttgtaattctaattaacactgtctccagacataaataaaattttaaatttctcattgctatcagctgtttccactatgtttttcataaattggaatgcaattttaaacagttaataaaattctccagtacaagagcaaaacaagaagttaaaggaacacaatagtctagaaac

SEQ ID NO: 27837 - DNA, 430 bp, Homo sapiens
  misc_feature 31: n = A,T,C or G
atggacaaatgacacaggttaggagacgtcnttttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagattgatgagcaaaggaggagtcaactaatgaagaaatgaataataaattttgacactgaaaaacattttattaataaagaatattgacatgc

SEQ ID NO: 27838 - DNA, 454 bp, Homo sapiens
  misc_feature 30: n = A,T,C or G
gaagacccgggctagactacttccctggcntggggccctggcagggtaggagtttggcaggcctgagaggatggctggaaggatttccgacagaggggagagcatatgagaagtcaaaaatgcacaaagaggcacagcgatgacgccatgtgcctggagagaaggggccaagacagaaatggcaagatgggagctgcagcagatcagagcgcagtgtgggtgtccttgaggggtgttgggttgccacgtggtagatgctgctaaagaaggggcccaatgtcagacttgacggagaagttccttccaactgtaggaggacagacagaggggtcagggagactggaaccaggaggaccagttaggagactatgacagactccatttcaacctagtcattgaatccagagagtaaactctgcttcctcccaaattcttgttgaattttaagatatat

SEQ ID NO: 27839 - DNA, 472 bp, Homo sapiens
  misc_feature 29: n = A,T,C or G
attccccaaggcctgtacaagaggaagtnttcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaaga

SEQ ID NO: 27840 - DNA, 331 bp, Homo sapiens
  misc_feature 30: n = A,T,C or G
gcaatctgtgttcttatctggagcttgggntgctatttcaagttcatatagttgggtacattggctcacgcctgtaatcccagcactttgggagatcaaggtgggtggatcactggaggtcaggagttcgagcccagcctgaccaatatggtgaaaccccgtctctactaaaaatccaaaaaattggctgagtgtggtggtgggcacctgtaattcagctactagggaggctgaggcaggagaatcacttgaaccctggaggcggaggttgcagtgagccaagatcgcggcattgcactccagccggggtgacaaagtgagactccatcac

SEQ ID NO: 27841 - DNA, 483 bp, Homo sapiens
  misc_feature 23: n = A,T,C or G
gagcaggatcaagcataattgancacctacagtctcagctaaagctaagggaaggggaagtcactcatttacaggtattggaaaaattaaatttgctatagaagtaaatgaagttttgaggcctaataaatagcacccttcatttccatctgaattctgagcaaattgagaaacaagatgacatagtggcatgtgaagcccaaaatgtatcacatatatcaatgataaaggctaaaaagagaaattagctaaggataacagccaactgaacctgctaattgccagaattaggcatattcggctgatctgtcacaggaaatgctgggctggagcaggcctcccatgttttacaacctgcctacataagacataagcatctaggagcagagaatccctcctcctttcaagcagctctttcccaacagaataaagggaagtcactgagctgtgaatgcctgttctattcagatttacctcttagat

SEQ ID NO: 27842 - DNA, 119 bp, Homo sapiens
  misc_feature 3: n = A,T,C or G
ctnatgaataagatctaagaagttacctggctacagaaagaagatgccagatgacacttaagacctacttgtgatttaaatgatgcaataaaagacctattgatttggaccttcttctt

SEQ ID NO: 27843 - DNA, 241 bp, Homo sapiens
  misc_feature 14, 85: n = A,T,C or G
ggggacgacacagnaggagacagaggattatatacagttcaggaagtcagtcctcgcagatcagggtaaaagttttgctactgcntctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcac

SEQ ID NO: 27844 - DNA, 490 bp, Homo sapiens
  misc_feature 30, 33, 56: n = A,T,C or G
atctccccaacaaccgactaatcaccaccnttnatgactaatcaactaacctcaanacaaatgatagccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactga

SEQ ID NO: 27845 - DNA, 309 bp, Homo sapiens
  misc_feature 31, 32: n = A,T,C or G
aaattccaaggggaaacacaaacctaaatgnntttcaggtacaatgcagatcatgccacacattatactttttgtttgttgtacagttatttgttctacttttgaaattcaaaaatatattaccatttcacagggtgctgctggcttccctggtgctcgtggtcttcctggtcctcctggtagtaatgtaagtaattgttaaagtcttttctcatcatacacttcagaaagagcattcatgtatgtataggatgagaaacttacacattgctacttatttctctagtaagtctcaaataaaattatttg

SEQ ID NO: 27846 - DNA, 106 bp, Homo sapiens
aactcccttcaattcaataatcaggactcctcttccttagaaggcagtaggtggctttaagtaatcattttttccctgtcatatatatatttgtatattcaaagac

SEQ ID NO: 27847 - DNA, 164 bp, Homo sapiens
acccatcagtgtgctgtattcaggaaacccatctcacgtgcagagacacacataggctcaaaataaagggatggaggaagatctaccaagccaatggaaaacaaaaaaaggcaggggttgcaatcctagtctctgataaaacagactttaaaccaacaaagatc

SEQ ID NO: 27848 - DNA, 462 bp, Homo sapiens
  misc_feature 31: n = A,T,C or G
gcaagcctaataccatagtttcaacaccgtnttgaatgtaaatggtatttggagatttctgcaactaccttaatgggatatgaaaatatgtgacttctgttgttgccagtagtttactgcctaccttcctaactgaaggaaatgctaaatttcagtaaaaggttaatgaaatagagatgtaattttcttttcatccaagtttacaggccccatattaaggacccgtcacagaggagggagcttgatctgatttttcaatggtgagttggagtttctcagaccaatgaaaatggagaagccacccaggcatgacagcgaactgtgcaaaagcggaaaacagatttgcccttcaagaaaattataaagcttgatactgctggagaaagggccaccaggcacaggatgatgcagaaggagaggaaaggccttggatactaggtcaaggcttgagtgaggaaggga

SEQ ID NO: 27849 - DNA, 331 bp, Homo sapiens
agtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgac

SEQ ID NO: 27850 - DNA, 188 bp, Homo sapiens
gaaggcccagcttcaaataacactatactgtttcacaggttgttttaggtattttaaaataaaatattactaatccctccttcttgtcccttgtatcattgctttcatttcagttatacctccgcatacacatgtgcatgcgtgcacacacacacataataattgaagaaccttttatctgttagatc

SEQ ID NO: 27851 - DNA, 408 bp, Homo sapiens
gagacggcgtagacctctgacaaatgctttgctgtgtgtggacagccacagccgttactgcaggtcttacagcaaactcttccaccaccagtgttccagatgcttctgactaagctcccaacaattagtcagagaattgtaagtgctcagagcttggctgaagatgatgtggaatgagaaacaaatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtctattttatttatttttcccagtgaaaagtgtattttgatagagaacctttcattctataaatacactatgagttact

SEQ ID NO: 27852 - DNA, 500 bp, Homo sapiens
tgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctacttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggccc

SEQ ID NO: 27853 - DNA, 365 bp, Homo sapiens
  misc_feature 26: n = A,T,C or G
aacctcaaggtccatcagaaaagcangcagaaacctctgatttaaatgcaagaattttaacaagaatacctgacaagagaaaaggccttggcctccctgaggagatactaactgcagagaactggataatgagaactcagccctgtaaaaatttgaagaaagtgttctgagaagagggagcagtataaaatccccaaagtagaaggaccttggggcagtaaggctgtggtctagtgagcaagaaagaatgtagtagaagtagagatgaaaggtttagacacaatccatgtatgtaaggctataattgtgataaatagctttgatttgaaactaagctcaatggaaagccattagagggtttcagg

SEQ ID NO: 27854 - DNA, 120 bp, Homo sapiens
gcaggggggagaatttggccaaatggctggactctctcaaacatctgtgagggacagagattgagagggagagacagggagaaattgagagagatataaaaggaaaagaggaggggaccc

SEQ ID NO: 27855 - DNA, 295 bp, Homo sapiens
  misc_feature 31: n = A,T,C or G
ggagactggcaacctgaaaaagctgtcattntacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttga

SEQ ID NO: 27856 - DNA, 369 bp, Homo sapiens
  misc_feature 25: n = A,T,C or G
ctggccgccgccacaatgggccgcnagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgct

SEQ ID NO: 27857 - DNA, 208 bp, Homo sapiens
agtgtctacttgagctcaagtcacatgttgtgccacaatgtcagtgcaattctgattctgggaaagaaaagaatttgtttcccctaaagtttctgaattaagtacttttatgattaaaaagaatgagagtttggtggtacagttgtgtttccttttatcccaatctgttcaggtccatagttaaaaatctatggtgctgataaggaac

SEQ ID NO: 27858 - DNA, 330 bp, Homo sapiens
  misc_feature 7, 316, 330: n = A,T,C or G
aatagancctgcagagcaaaggaagtggcttattgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttntataaacttttttn

SEQ ID NO: 27859 - DNA, 226 bp, Homo sapiens
  misc_feature 24: n = A,T,C or G
aaggtcacaactcctgacacgtcnaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccg

SEQ ID NO: 27860 - DNA, 358 bp, Homo sapiens
  misc_feature 33: n = A,T,C or G
cagtgacaaggaaagattctttttctaggaaanatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgc

SEQ ID NO: 27861 - DNA, 435 bp, Homo sapiens
  misc_feature 6, 22: n = A,T,C or G
attgcncaaaacttttctagtngcaagtgcttgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattg

SEQ ID NO: 27862 - DNA, 218 bp, Homo sapiens
  misc_feature 217: n = A,T,C or G
atgatccagagagttaattttttatttttgctttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaattnt

SEQ ID NO: 27863 - DNA, 490 bp, Homo sapiens
  misc_feature 34: n = A,T,C or G
aatctaccagaaagtaactcatgttcccaaattnatatgtccaaaataaggagacaaatgagcgcaagcacctcaaaaggcaagtaaaagataacaaactgtgtgtatgtgtgtgttttcttgttttatgttgttaatatctttgtgtatatagtagaagcaaaggcagatggaataaaaagaaaagtctaataaattttctaaaagatattaacaacatgaaacaagaacaaaaacttacttaataggaccaaaggaaaatactaggtataagaagtataatctatagaacacatttgatgggatgaaattaggatcagttaaggtgaaggagaaattagtgagttggaagatcatatttagaattctttccataagaggaaagaaaggatataatatgaagcataaaataaaaattaagaaataaatgaaattcaaaagtaggagttcctttttcccctaagatcaggaacaagataaaggtatttgc

SEQ ID NO: 27864 - DNA, 123 bp, Homo sapiens
  misc_feature 22: n = A,T,C or G
aagttaatgaatagtttttgtnttatcagaatggcaacagacagaagtactttgtagagattgacttcctaagctacttaagacaacttgcaccactaagaaaaaaatgtagaaccatttgcg

SEQ ID NO: 27865 - DNA, 114 bp, Homo sapiens
  misc_feature 25: n = A,T,C or G
cacatttagtccccacaataatttnatgagatagggggatttatcctaatgtcacagatgtaaaagcataacatcaggagtgcttaagtgatttacccaagacactgacctagc

SEQ ID NO: 27866 - DNA, 466 bp, Homo sapiens
  misc_feature 387: n = A,T,C or G
gttatccgcgatgcgtttcctggcagctacattcctgctcctggcgctcagcaccgctgcccaggccgaaccggtgcagttcaaggactgcggttctatggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggnggagtggcaactttcaggatgacaaaaaccaaagtctcttctgctgggaaatcccagtacagatcgtttctcatctcta

SEQ ID NO: 27867 - DNA, 425 bp, Homo sapiens
  misc_feature 24: n = A,T,C or G
taggaactgagattgctggtccancagctccagctctgttaatccccacctctgttaagaatccatcccagtgcaggattattggtaacacttagaggggaggggcctaagcccactgctcagccacagtcccgtggctaagaaggcgtgctgtcggattgctggcggacttttctgctttaccccaggcagaagggttttgagaggggctgaaccctgaccaacatgaccctttcactgggaactgtttcatcctgggcaaatgtccctgcagcctcgtggccaccaccccatacacctgccagattttcagggaggaacaggagggtgattacacaagaaccgtacgatacactttgaaatatacccacttctctatttaattggaatttgataaccatctcttaaatgggccaggagtatga

SEQ ID NO: 27868 - DNA, 345 bp, Homo sapiens
aaacagcttaaagtttagtttaacagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagta

SEQ ID NO: 27869 - DNA, 490 bp, Homo sapiens
  misc_feature 270: n = A,T,C or G
atataaccaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtaagtntactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaact

SEQ ID NO: 27870 - DNA, 300 bp, Homo sapiens
  misc_feature 7, 105: n = A,T,C or G
attttcngttaataatagtaaacacacagtatttgttctatgcatttcacgtgtatttatcccagtcagtcctcaaaacaacccaatgagctgtccccagattanagttgtggagaccgaagcactgagaggttaagtcagttggccaaggtggcacagccagtaaatggcagcgccggcacatgaatatgggcagtctggccccagagtctaggtttttaaccacacactatgctatatttttcctaccatttctaaccctctttttcttgttaagcaagcagtttacttctttccaca

SEQ ID NO: 27871 - DNA, 101 bp, Homo sapiens
agcaagaagggaaagacagagagcgagaaaaaagaggagtcagtcgctcctggggaagggagagagtgagactgggagaaagagaagcacagaaagtgtgc

SEQ ID NO: 27872 - DNA, 102 bp, Homo sapiens
  misc_feature 19, 34, 51, 67, 70, 73: n = A,T,C or G
gtctggtactaaagcattnatggcggctcttcangctggtgcagacatctncatgattgggcagttnggngtnggcttttattctgcctacttggccggcag

SEQ ID NO: 27873 - DNA, 359 bp, Homo sapiens
  misc_feature 19, 24: n = A,T,C or G
tcgtctttaaaccctgcgnggcanctccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaat

SEQ ID NO: 27874 - DNA, 500 bp, Homo sapiens
  misc_feature 25: n = A,T,C or G
tgcaggaacatgagcaaggcagacnctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagctgaaggcctgctgacccagggtgataagatcactgctgatggacttcaggaggtgtttgagaccaatgtctttggccattttatcctgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacagga

SEQ ID NO: 27875 - DNA, 142 bp, Homo sapiens
ataggagtccagaaacatacctgtctgtgtacgtttaattgattgtggacaaggttgctagttgacagggaaagaattgtctttcgacaaatggtgctgagacaagtggatagccacacacaaaagaaccaacaccatatcc

SEQ ID NO: 27876 - DNA, 477 bp, Homo sapiens
  misc_feature 20: n = A,T,C or G
gtggaagcagggcagaaagnagacagaggcataccagcaagtacagacatctaaacacaaagagaggagaacaacctcagggatactccctcagtgcctgggaagaaagcaaaacttaaagtgctcatagaattgtaaataaactctctcctctttgaaatttatgttcgatggttgctgtgtagttgcaacagtgtcataaagtccatgaggcctattttttttgagtaatcaatattgtggaaaagtgctagagcagacctaccttatataaattaatttgtttgaattgctctattcactatgaataaatatttattggagtaccttctatatgctggggacctcagccatgagatacgcaggtggaaaaaataacacttaagcagcttattgtatagcagagaggtggttgaattgatagacaattaaaatacaacgtgttgaaaggcctgttaaagccacagggtcactcag

SEQ ID NO: 27877 - DNA, 473 bp, Homo sapiens
tggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggttgtgagactacctattgtagatattgcaccctatgacattggtggtcctgatcaagaat

SEQ ID NO: 27878 - DNA, 167 bp, Homo sapiens
gttcaaggagaagtcctacaaagcacggtcatcgaggggaagcagtacgacagcattttgagggtggaggccgtggatgccgactgctcccctcagttcagccagatttgcagctacgaaatcatcactccagacgtgccctttactgttgacaaagatggttatat

SEQ ID NO: 27879 - DNA, 372 bp, Homo sapiens
  misc_feature 17, 371: n = A,T,C or G
aatgactttcttccagnaattggaaaaaacgactttaaagttcatatggaaccaaaatagagcccacatcgccaagtcaatcctaagccaaaagatcaaagctggaggcatcacgctacctgacttcaaactatactacaaggctacagtaaccaaaacagcatgatactggtaccagaacagagatatagatcaatggaacagaacagaaccctcagaaataatgccgcatgtctacaaccatctgatctttgacaaacctgacaaaaacaagaaatggggataggattccctatttaataaatggtgccgggaaaactggctagccatatgtagaaagctgaaactggatcccttccttacaccttatnc

SEQ ID NO: 27880 - DNA, 282 bp, Homo sapiens
gagttcattttttttaattgtgatgcatacagccaggatttgacacagaatcttaaaaatagaatgtttatttttgaggtaaaatttcatatcagattaatcagccaagtaaaagtttttctttcagtatctttgatttggttatattacaaattacaatgtcgtattttagtttctttcttactatattttatacaggaatataagaatactccactactttatggaaacttcatgtactttttttgaacactttaggccttgccacctcattctttaatg

SEQ ID NO: 27881 - DNA, 248 bp, Homo sapiens
  misc_feature 91: n = A,T,C or G
ggtgtgtgtgcgtgtgtgtgtgtgtgtgtgaagtcttaaatgttttattagtctacagctaatcagtttattgtaatattgtatgtacagngagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaattttaaaaaat

SEQ ID NO: 27882 - DNA, 229 bp, Homo sapiens
  misc_feature 228, 229: n = A,T,C or G
tatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcgcgaggactgctgtactgcnn

SEQ ID NO: 27883 - DNA, 270 bp, Homo sapiens
caagataacatttttattaaagctctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatcc

SEQ ID NO: 27884 - DNA, 467 bp, Homo sapiens
ggacacagtgcaaactacagtttgaagtagttgcctgtttcatgagattcctgtagttcttttcaatgatgtcataagcctacaaagctggcttttgggcaattgccgcgataaaacgcaagtatttatgtacatctatcatgcatcaatagaaatatttgttttataaaaaagcaagtatctcttaaatcagtgtggaactggaaatggagttggtggcgtccagtctgattccagggtttgggaagttgggcagtgcccagcagacactgagttgacaggacataagtaatgattaagttgtttggccctaactacatacttaattggaactgtgaggtatttattttggcctaagtaccatgaaaaaattactgaaaccctaaggaccgtgtggcctgagaaagtttgggaccctctaaccttgaattctgctgctgccttttgtaccctggtttttctttctt

SEQ ID NO: 27885 - DNA, 473 bp, Homo sapiens
cagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgc

SEQ ID NO: 27886 - DNA, 160 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcc

SEQ ID NO: 27887 - DNA, 135 bp, Homo sapiens
  misc_feature 4: n = A,T,C or G
aacnaaaaatccctgtaggcgtgctagcaattccagggtggtccgggtttggcagatttgatttttaaaaaacgtattatctttaataaaatgttattatgtcaaccagtgaggctgccctgaacaaaaaaaaac

SEQ ID NO: 27888 - DNA, 209 bp, Homo sapiens
tcttttctcttgagaacataaagattgaacacagaggtgacgcttaggtttaccagatacccacaaggggtactcaggcacaaataaggatgcacaggggagcgtggtgcagtccccagggccaccatgagggcatccccctgcagcagactgctctgttattccttaataatttccctgcaaagagagaaagtacagggtctagacac

SEQ ID NO: 27889 - DNA, 157 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttg

SEQ ID NO: 27890 - DNA, 474 bp, Homo sapiens
agaattctaagaatttttcttagaatgaaaaattgggagcagccttcaacacttacagaagctggattttcctcaggtttctttggctcaggtgcagatctggagtcttgatcctttttgccatctttcctgcagagacgtaagcataaaaccatgtctttaggaaaggactcgcctaatacaaacatgtgtatgcatgcagtttcaaggcactgaacaggcacctctagtcaacagtccttgttgtctggatgatgtattacttctagattttcagaatcttaactgtctacgttggctgactttagtttgctcacaatgagcgatctggcagtgctctgagaaccaagaacttaatttcttaattacacaaacacgtggatcagaggaaagatgagaaagagaacaagcatacctatctgactccttccagtggtctctgttccctccgtctcctggaccacggctagagtt

SEQ ID NO: 27891 - DNA, 331 bp, Homo sapiens
ggattgctggcaatgttttacccataaactcattctggaaagttcagttttcatcatgctagaggcttggaccagttattcattcttggaagcaatagtgcccagcagcggggccaggatgagggtgaagagagtaagtccaaggcctagacagagtctcactctggagtgcagtgttgtgatcgcagctcatggctggtctcaaactcctggcctcaagcaatcttcctgccttggcctcccaaagtgctgggattacagatgtgagccactgtacctggccaactaatcttgatttttaaaataatgcattaaagtattacttattttg

SEQ ID NO: 27892 - DNA, 471 bp, Homo sapiens
aactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaacctgggaacatctgaatgctgaggcttagtccagtgttctctctcccttaccactcctcttccccttccctctataatggcagtacccagggcccggtccatagactactatcgagtgctcctatgtgcatcttagtacgtatcattttcccttgcctttttccttctatcctttcagtggtagcaactgcccttgctaatcaccgtaacctcggctgagaaagaagaggaagcgaaatccaagatgcagctcagttcatcaaagcctagcag

SEQ ID NO: 27893 - DNA, 105 bp, Homo sapiens
ctcgggaggctgaggcaggagaatcgtttgaacctggggggcggaggttgcagtgagctctcatcactgtactccagcctgggtgacagtgtgagactctgtctc

SEQ ID NO: 27894 - DNA, 339 bp, Homo sapiens
ccggcggtgacgacctacgcacacgagaacatgcctctcacaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 27895 - DNA, 237 bp, Homo sapiens
  misc_feature 11: n = A,T,C or G
ggaaaactttnagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttcg

SEQ ID NO: 27896 - DNA, 383 bp, Homo sapiens
  misc_feature 5: n = A,T,C or G
caacnaagatgcaaatgttttgaaatgatatgaccaaaattttaagtaggaaagtcgcccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcc

SEQ ID NO: 27897 - DNA, 229 bp, Homo sapiens
  misc_feature 4, 20, 34, 37, 63, 79, 94, 179, 186, 188: n = A,T,C or G
attngagggcggatcctctntggcgtggagaccnagnatgaagatgcatgaggaccattgtangtccgccgagactatntgcactacatccgcnggtacaaccgcttcgagaagcgccacaagaacatgtctgtacacctgtccccctgcttcagggacgtccagtatcggtgacatcntgcacancngggcgagtgccgggccttctgagcaagacagtagcgcttca

SEQ ID NO: 27898 - DNA, 476 bp, Homo sapiens
cacttccactatgtcctatcaataggagctgtatttgccatcataggaggcttcgttcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataatcttcatgatttgagaagccttcgcttcgaagcgaaaagtcctaatagtagaaggaccctccataaacctggagtgactatatggataccccccaccctaccacacattcgaagaacccgtatacataaaatctagacaaaaaaggaaggaatcgaaccccccaaagctggtttcaagccaaccccatggcctcca

SEQ ID NO: 27899 - DNA, 108 bp, Homo sapiens
gacaaccttagccaacctttacccaaataaagtataggcgatagaaattgaaacctggcgcaatagatatagtaccgcaagggaaagatgaaaaattataaccaagcg

SEQ ID NO: 27900 - DNA, 164 bp, Homo sapiens
gtacgactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcg

SEQ ID NO: 27901 - DNA, 212 bp, Homo sapiens
gtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagccttcttaaatgacaaatgtg

SEQ ID NO: 27902 - DNA, 473 bp, Homo sapiens
  misc_feature 8: n = A,T,C or G
gaaccatnagatatccaaataacagaatagataaaataagtgggaaattagaaaaggaaaatgttgtgaatttaccacatgaaatttcatttctagttaagcctcagtgatctatattgcctgtaattatagccacaatgtgtaagacccggaaacatgtataacctcactcagtgattcatgattatgggaaagtatttattttgtatctatttgttttgtacctattgtacccaaccaacatttgtgtatggtaaataacctggaaggacagttcactggattcttccatcgagataatataggcaaaatgaaaaagactaatattagtctacataaaagtattgtattatgcattaaaacccagaaatttaattgatattcaagacataggtatcctatgaagctggaactagttagatatttgaagcttgagcctcagctaaggagatgttaagaatttatgtaaattc

SEQ ID NO: 27903 - DNA, 472 bp, Homo sapiens
ggaaatagaaaaaagaacctacatttattttgctttagcatccttactctcaccttttatgagattgagagtggacttacatttccttttttacattttcgtatacttattttttttagccatcattatatgtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaattttaaatatattttgttcttcaaataaatagtgtttaaacattgaatgtggttttgtgaacaatatcccactttgcaaactttaactacacatgcttggaattaagttttagctgttttcattgctcag

SEQ ID NO: 27904 - DNA, 254 bp, Homo sapiens
  misc_feature 254: n = A,T,C or G
ggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagcttn

SEQ ID NO: 27905 - DNA, 293 bp, Homo sapiens
  misc_feature 29, 286: n = A,T,C or G
agcctcattttacccagcccctattcagnatggagttgctgtggttcaaatgtctctgacaataccataaagataaaaatcatcaaatttaattatataaaatttaaaatctctaagtaagacactataaacagagacagaaagtgaagtgggaaaaaatatttgctgcctatattagttttaaaagcccgatgacgagttagtgggtgcagtgcaccagcatgtcacatgtatacatatgtaactaacctgcacattgtgcacatgtaccctaaaacttaaagtntaataat

SEQ ID NO: 27906 - DNA, 424 bp, Homo sapiens
gtttgtaataatgctaatggaagaggtgagatttgggtggggtggggtgtagatgggaacatggtttggggattggggaaagggaagtcatgctgttaataaaatagtgaggcatgttgtataaagtgtgttttatgtctcaattgaaatgttatagagataaatttaaaatagatcatgatgggttttgaatctgatttctaattttaaaatgttatgagcttttgttgctttcctatttcatacacatttctttatgggtttcacttagactgcatgaaattgcagatgccaattaccttttaacaaaattaaattcacatatatgtataatttgcatgtatatatccatggaattttttattctacacgatatattattttaaaatgggtttttcaatgacaaaataaaaagtatttttct

SEQ ID NO: 27907 - DNA, 239 bp, Homo sapiens
gggaactggatcaaaggtgactcttgttatgttttagcaaagagactggcagcattttgccccttccctagagatttgtagaactttgaacttgagagagatgatttagggtatctggtggaagaaatttctaagcagcaaagcattcgagaggtaacttggctgctctcaaaggcattaaattttacatgggaaacagaagataaaagtctggaaaatttgcagcctgacaatttgat

SEQ ID NO: 27908 - DNA, 188 bp, Homo sapiens
gaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattgg

SEQ ID NO: 27909 - DNA, 214 bp, Homo sapiens
ggggcttggaaggaaagctataggctacccattcagctcccctgtcagagactcaagctttgagaaaggctagcaaagagcaaggaaagagagaaaacaacaaagtggcgaggccctcagagtgaaagcgtaaggttcagtcagcctgctgcagcttttgcagacctcagctgggcatctccagactcccctgaaggaagagccttcctcaccc

SEQ ID NO: 27910 - DNA, 208 bp, Homo sapiens
  misc_feature 141, 162, 203: n = A,T,C or G
gtttctctttcacctggctattactgaaagtgggatgcttttgaggcagaataggaaagtgcattggctttggagtgagatctggatttgaatcctggtgttcttgccacttaagagttgcattatttacggctggtcacnggtggctcacgccctgtaatncccaccccttttgggaggctgaggaaggaggatcccttgangggag

SEQ ID NO: 27911 - DNA, 473 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcgaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgata

SEQ ID NO: 27912 - DNA, 472 bp, Homo sapiens
acagacttaaaggtagaggaacttactgccctggggaatctgggggatatgcctgttgatttctgcactactcgggtaagcccagcacatagatccccaactgtcttgtgtcagaaagtgtgtgaagaaaattctgtatcacctatagggtgtaattcctccgatcccgctgacttcgaaccaatcccatctttttctgggtttccgttagattctcccaaaaccttggtgcttgactttgagacagagggtgaacgaaactcacctaatcccaggagtgttaggatcccttctcctaacattttgaaaactggacttacggaaaatgttgaccgtggcttggggggcctagagggaacacaccaggcccttgacctgttagcaggaggaatgatgcctgaggaagtaaaagaatcttcccaattagacaaacaagagtcactcggattggaattaaaaacaattaattctg

SEQ ID NO: 27913 - DNA, 473 bp, Homo sapiens
gggggttttctcttctgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaaattttactacttttgagattgccccaatgtacagaattatataattctaacgcttaaatcatgtgaaagggttgctgctgtcagccttgcccactgtgacttcaaacccaaggaggaactcttgatcaagatgccgaaccctgtgttcagaacctccaaatactgccatgagaaactagagggcaggtcttcataaaagccctttgaacccccttcctgccctgtgttaggagatagggatatttgcccctcactgcagctgccagcacttggtcagtcactctcagccatagcactttgttcactgtcctgtg

SEQ ID NO: 27914 - DNA, 143 bp, Homo sapiens
  misc_feature 142: n = A,T,C or G
aaatgtaaatacactgatttattctgttactagatcaggttttagggtcctgcaaaaggctagctcggcactacactagggaatttgctcctgttctgtcacttgtcatggtctttcttggtattaaaggccaccatttgcnc

SEQ ID NO: 27915 - DNA, 471 bp, Homo sapiens
  misc_feature 365: n = A,T,C or G
gttctaatgttttagcattatttagagggaatgctcattttatttagacattaagtcagggaacctttcagatctgagatttgattgtaccctccttgaaagcttataagttagcctattactgttttctggatacaggcagaaaatgcaagattcctgggccagagaccaaggacattatcactaacagtacagcaagcagcatgaacattagcatgtttgtgttggtttctcttgctctcaaatcctatggaaacaacatcaaggacctagatgatacctgcatatgtagtggattacattacaagagagaaaccatgagcttaaggaattggatttttttttttgccttccctttgttcaanagagagggcctgtctttttcttctaaggctattagtaaatctgtcttttgtctagaaggagattccatttctgctttccaaggctgttttttatacaaacatattt

SEQ ID NO: 27916 - DNA, 244 bp, Homo sapiens
atggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtg

SEQ ID NO: 27917 - DNA, 271 bp, Homo sapiens
gacaaagggcaaaattttcaattaaactgcaacaaacatgcacctttttgaatcacgaggtcaggagttcaagaccagcctggccaagatggtgaaaccctgtctctactaaaaatacaaaaattagctgagtgtggtggcaggcacctgtaatcccagttactcgggagactgaggcagagaattgcttgaatccaggaggcagaggttgcaatgagctgagatcgtaccactgcactccagcctgggtgacaaagcgagctccatcaga

SEQ ID NO: 27918 - DNA, 391 bp, Homo sapiens
atttctaggtaggagaatgtcagtagatgatataccctgctgagttcaaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaactcg

SEQ ID NO: 27919 - DNA, 473 bp, Homo sapiens
ggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttgggaaaagatgccttctggatcttaagccagttgtcagtgggaggtcctcagggctgca

SEQ ID NO: 27920 - DNA, 144 bp, Homo sapiens
  misc_feature 142: n = A,T,C or G
aaggggtggtatgacccaaagttcctctgtgacaaggttggccttgggaatagttggctgccaatctccctgctcttggttctcctctagattgaagtttgttttctgatgctgttcttaccagattaaaaaaaagtgtaantt

SEQ ID NO: 27921 - DNA, 467 bp, Homo sapiens
atagggattacgttgattttttttaaagtggcattgggaatatatccttaagtgaatcatatctaggcaataataatttgacacaagtccattttgatccattttttaaaaaaggagtgctagaggagaagtcttagccccaaattcctttccttctttgtagcgtaccttgacgtgcgtgtgaacaaatgggattctttattgctttcttgtattcttatctcatcctcttaaccgattttgtctcaagtcttcccacttagaaagtgatatatttttaggacctattccaaaaacttgttggatataaagagcactgaaagagagaagaagaaaagttggggcaagataggatgtttgtatgtatgtttgagatttttctttgttttcagcgattttactggggtccttctgacgggataggcataaacattatggggtgtgtggcagagatgacatcagtggct

SEQ ID NO: 27922 - DNA, 473 bp, Homo sapiens
aggaagggcacagtgcttttactaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgc

SEQ ID NO: 27923 - DNA, 190 bp, Homo sapiens
agaataaataatggaaagcacttgatatacaagtttatactaaaatttcaactgtgtgaagatacattttaaggcattactttgctaataatctacacattcttttttctattaaataaacaaatggtttgtggttcacaagctttcatccaagcttggtgataatcaattttgaaaatacagtggactg

SEQ ID NO: 27924 - DNA, 473 bp, Homo sapiens
tattattgagcacaaccaatggctgggagctctgttaggtgcttatttacataacctgtggccctgacaacattctgcagggtaggtgttgttatccctatggacgatgtgatgtgaggaaatcagcctatagagggtaagtgacttatttaagagaacaaacctagaagaagcagagctgatattcccagctggggctgcctgactgtaaagcctagcctatgtcctatgaccctaagagatttagcaacatatcctgggtttgttaacaatgatgattgtacctggtagatgtttaaaaattagaatattgggccgggcacagtggctcatgcctgtaatctcagcactctgggaggctgtggcaggtggatcacttgaggtcaggagttcaagaccagcctgccaacatggtgaaaccccgtctctactaaaaatacaaaaaattagcaggacatggggggtgggcacct

SEQ ID NO: 27925 - DNA, 363 bp, Homo sapiens
  misc_feature 358: n = A,T,C or G
caggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaggggggttgggtttgnttatt

SEQ ID NO: 27926 - DNA, 472 bp, Homo sapiens
accacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggggaggtggaggcatttgttttttaagaaaaacatgtcat

SEQ ID NO: 27927 - DNA, 468 bp, Homo sapiens
attgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctt

SEQ ID NO: 27928 - DNA, 268 bp, Homo sapiens
  misc_feature 26: n = A,T,C or G
ggaaaggaggaagactttttcccagnatctctctaccttaaagcatggagccaagtagcttgtattagtcctaggattccttttctcctgcaaaactggtggtagaaacagtggcatgcgggggatggtacataagctgaccatccttaaccagctcctatcaggactcactgtcagctcagccatggaaacactttttaaggggtgtggacaagcaagcaggaattggagtgaaactgtcaacctcagttggatgaaaactgggaag

SEQ ID NO: 27929 - DNA, 471 bp, Homo sapiens
attgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccacagtggccataccaaaggggctaccgattccttcctgctaccct

SEQ ID NO: 27930 - DNA, 471 bp, Homo sapiens
ggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagt

SEQ ID NO: 27931 - DNA, 175 bp, Homo sapiens
  misc_feature 24: n = A,T,C or G
ctcttcgaaggctcactctcaagncacgactaagagccttctgagcccagcgacttctgaagggccccttgcaaagtaatagggcttctgcctaagcctctccctccagccaataggcagctttcttaactatcctaacaagccttggaccaaatggaaataaagctttttgacc

SEQ ID NO: 27932 - DNA, 472 bp, Homo sapiens
gattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttaggtttgttcttcagattgtagggagttttaaagaaattttagtagttactaaaattatgttactggatttttcagaaatcaaactgcttatgaaaagtactaatagaacttgttaacctttctaaccttcacgattaactgtgaaatgtacgtc

SEQ ID NO: 27933 - DNA, 375 bp, Homo sapiens
gggggattgtgtttaaatcaaatatatgtattttaaaaataatgacatgctcaaccatcctcatcatggagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatggtttattttctatgtgtgtgcatatagttcaatattatgcaataaatttgggtgtttt

SEQ ID NO: 27934 - DNA, 378 bp, Homo sapiens
  misc_feature 221: n = A,T,C or G
atttgtgggtggattttttttgttgtttgtttgttttgttttgttgtgtttgtgagacaggttctcactctgttgcccaggctggagtgcagtggcacaatcaaggcttactgcagccttgacttccctgggctcaggtgatcctcccacctcggccacctgagtagctggtactacaggcatgcaccaccatgcctggctaattttcgtattttttgtgngagatgaggtttcgctctgttgcccaggctgctcttgcacttctgcgctcaagcaatccacctaccttagcctcccaaagtgctaggattacagtcatgagccaccacacccagcctgggactgacatttgaatgttagtctccagtgaatttcaga

SEQ ID NO: 27935 - DNA, 164 bp, Homo sapiens
catatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacactg

SEQ ID NO: 27936 - DNA, 170 bp, Homo sapiens
ggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttct

SEQ ID NO: 27937 - DNA, 372 bp, Homo sapiens
  misc_feature 370: n = A,T,C or G
aggacaatgtatttttaaccattgataacaaatgagaattaagaatgtgcttccgttatagcctgttaaaagtagtttaggctggccaggtgtggtgactcatacttgtaatcctagcattttgagagattgaggggggtggattacctgaggtcaggagttcgagactagcctggccaacaaggtgaaaccttgtctctactaaaaatacaaatattagctgggcgtggtgatgccagcctgtaatcccagctacctgggaggctgaggcaggagaatcgctggaacctggaagacagaggttgcagtgagctgagatcatgccactgcactctagcctgggcagcagagcaagactctatctcaaaanga

SEQ ID NO: 27938 - DNA, 347 bp, Homo sapiens
atagacgttgcctgccatcctggctacgctcttccaaaagcgcagaccacagttacatgtatggagaatggctggtctcctactcccagatgcatccgtgtcagctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgct

SEQ ID NO: 27939 - DNA, 418 bp, Homo sapiens
  misc_feature 47: n = A,T,C or G
atttgtcccatttttgtttttaaatgtatttttataagatgtatacntgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatgggaagaagggaaaaaagccttcatttttgacctccccttactgaataaattgaatatggaagtttgccttttca

SEQ ID NO: 27940 - DNA, 471 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttggaaggcgatcttttaaaaagagattaaaccgaag

SEQ ID NO: 27941 - DNA, 468 bp, Homo sapiens
ggctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttac

SEQ ID NO: 27942 - DNA, 395 bp, Homo sapiens
  misc_feature 6, 10, 32: n = A,T,C or G
aaactncaancaaaactgcacaactacatggnaaactgaacaacctgctcctgaatgactactgggtaaataatgaagttaaggcagaaataaataagttatttgaaaccagtgagaacaaagacacagtgtactagaatctctgggatacagctaaagcagtgtttaaagggaaatttatagtactaaatgcccacaggagaaagcaggaaggatctaaaattgacaccctaacatcataattaaaagtactagtgaaacaagagcaaaaaaattcaaaaactagcagaagacaagaaataactaagatcagagcagaaatgaaggagatagagacacgaaaaacccttcaaaaaatcaatgaatccagaagctggttttttgagaagattaac

SEQ ID NO: 27943 - DNA, 242 bp, Homo sapiens
  misc_feature 13: n = A,T,C or G
gtttacgcccganagaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaac

SEQ ID NO: 27944 - DNA, 242 bp, Homo sapiens
  misc_feature 242: n = A,T,C or G
atcatttcgcatgttacatagttgcagttatatagtaagtagccttttcagactgccttcttttacttagtaatatgcttttaagtttcctcatcttttgaggacaagatagcccatttctttttagtgctgaattatgttctattgtgtgtaccatagtttatccattcacttactgaagggcatcttggttgcttccaaattttagttattttgaataaagctgctataaatccctgttn

SEQ ID NO: 27945 - DNA, 477 bp, Homo sapiens
  misc_feature 373: n = A,T,C or G
gaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagagacacgtttggtttggagagtccatggatgggngggttttcagtttagctacggcaatcctgaacttcctgaagatgtccttgatgtgcagctggcattccttcgacttctctccagccgagcttcccagaacatca

SEQ ID NO: 27946 - DNA, 219 bp, Homo sapiens
gcaggtggatcacgaggtcaggagttcaagatcagcctggccaacacggcaaaactcagtctctactaaaaatacaaaaattagccgggtgtagtggcacgtgcctgtagtcccagctacttgggaggctgaggcaggagaattgcttgaacctgggaggcagaggttgcagtgagccaagtgcactccagcctgggcgaaagagcaagactctgtctc

SEQ ID NO: 27947 - DNA, 462 bp, Homo sapiens
agaatagtcatgtcaattctcatttcagaaatcttcctaccttcccccttaaagtgtaatagagaccacactcttcattctgacctacaggaccttccataattcagtccctgattatagcttctcgtatcttaccatcttacctcctacacacgttgctccacatgcagacattcatacctaaaagttccaattctgagtcatttcagatcctggaagggttattttcacctcttaaaacaccagaacatgctcactatcttactatcttgctagttaataacaataatagaagaaaaaaaacttttctgggcttttacagcctgtcatgtcctgtgcgaagagttttaccgtcatcaccacagtaactatcaacaatattcctatgacgagagtgctttgcttttcctttgtctgcactttgggaagctgatgctatgggtggggatggctttataaatt

SEQ ID NO: 27948 - DNA, 403 bp, Homo sapiens
  misc_feature 14: n = A,T,C or G
gtcacctaaccatnatggaaggcaactcacacctgctccaagcctcagctttgagaaacaaacacgtttataagaaaaaatatatagctattattacagaagtgaatatgttgtgctctcttactgctcttggtgcattgacagtttctgtatctcaaccctattcatctttatgaaaaagcattctgaagatctatcctcagcactgctgagtgtgcagtcacactttcctaccaacccccttcttaccatctctagctgccatttgtggggggaacaaaacaagggaatcctgattgtgtacagtataaattgtattatatttttttgtacttatgttttatgtaaatagtttgtctcattcaattgtatgtgagcattgaaataaatcctaccatttagg

SEQ ID NO: 27949 - DNA, 470 bp, Homo sapiens
aacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgctta

SEQ ID NO: 27950 - DNA, 361 bp, Homo sapiens
gggggaagcggcggcaggcgccatgtccggccgcgaagtggcaagaagaagccctgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgc

SEQ ID NO: 27951 - DNA, 290 bp, Homo sapiens
gttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttcttttt

SEQ ID NO: 27952 - DNA, 476 bp, Homo sapiens
ggagaagtccacttaaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagcttggtggttggcactctgacaccgagctcggtcttcct

SEQ ID NO: 27953 - DNA, 278 bp, Homo sapiens
cgcagtggctcatgcctgtaatcccagcactttgggaggccaaggcaggcagatcacttgaggccagttcaagacaagcctgggcaacatggtgaaactctgactctactaaaaaaatacaaaaatgtgccaggtgtggtggtatgctcttgtagttccagctactcaggaggctgaggtgggaggatcacttgaacccgggaggtccctagaagttgcagtgagccaagatcacgccactgtactccagccttggtgacagagcaagactccatctc

SEQ ID NO: 27954 - DNA, 471 bp, Homo sapiens
gaaacttaattgaaatccaacatcaagtatttcttgttatacagtctgtcttttttccttttggaatttcttttgtctgttactgtgctatgataagctcatctgcgatttcagcactttggaagagatattttacaaaggaggggaggatacaagaggaatgataaatggcaaggaaaaccactcactcttaatgctttttgtcatactcatgtcctcttgtcccgtcaaacataccttttctgcaatgaattcaactcatgttatgtgacattgtcattttacaagggaagactagccagagaatttctgatggatgccaaagacatgggagtggtactttacattttgtaggtgattgatagggtttagtgtcttgtatctagaaagtggacacatagagtagagcagcttattcgagactcttctccctccgtccatagccaaggaaattataggaagcattctagt

SEQ ID NO: 27955 - DNA, 467 bp, Homo sapiens
  misc_feature 20, 340, 358, 401: n = A,T,C or G
ggctgggcaactgagcgagnactttgtctcaaaaaaaggaaagaaaaatttttaaaaagtttatcattcagttatcatgtctgtattttctttcaatagatttttggagtttactatggatattgtaacaaaaacaggggtttaggaagcgtacagcaccttcaaaaaatttttaatttaaattactttctcactacctagttcagtgatttggtttttaaccagtaaaaaataaggcagtttccaggcagggcataatagaaaagaaaaaaaatacaatttaaaaataaaaacaaacaaaaaaaaacttctttatagtccttatatatttttaattggnttatgttaggggaagctntagaggaacaaatttgggatagaaatataaggctgggtgtggngcctcacacctctaatcccagcactttgggaggccaaggcaggtggatcacctgaggtcaggagtt

SEQ ID NO: 27956 - DNA, 148 bp, Homo sapiens
gggtataagatctgaacttttctctgcagaggcaagaaaaatatttgacattgtgacttgactgtggaagatgatggttgcatgtttctagtttgtatatgtttccatctttgtgataagatgatttaataaatctctttaaatactt

SEQ ID NO: 27957 - DNA, 471 bp, Homo sapiens
gggggcattcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatat

SEQ ID NO: 27958 - DNA, 105 bp, Homo sapiens
gggaggctgagacaggagaatcacttgaacccaggaggcggatggtgcagtgagccgagatcgcgccattgcactccagtgtaggggtatcgcagcgagactctg

SEQ ID NO: 27959 - DNA, 105 bp, Homo sapiens
caaaagacatttgctaaatatggagaaccaggagaagtttttatcaacaaaggcaaaggattcggatttattaagcttgtgagtgtaattgtttgattttacgcc

SEQ ID NO: 27960 - DNA, 476 bp, Homo sapiens
atccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtg

SEQ ID NO: 27961 - DNA, 113 bp, Homo sapiens
caccatcaagtactgttaacgtgcttttttagactggaaactttcccaaggccgttttccccacccactgacttgcctttagccatgatcatcattgcttttgtcctgtctgt

SEQ ID NO: 27962 - DNA, 447 bp, Homo sapiens
agcatacctgctagttaaatatacaaaccgattttatctttaggccttattgcatctaaacagtgtcagaacctcagatgattgtgaattttcctaggtatggtaatgatattattatttaggagaatatctttactttttagagatggatttcagtgtacttagagtaaggtatcaaaatgtctgcaacttacgctcacatgtttacaaaaaaatatatctgcacagatcaataaagcaaaacaggcatgctagcaattattgaatctagatactagatatacagatgtttactatactttttaccgctaacctttctgcatgtttgacatttttcataataaaatatagaagagaaaaaagaatcattgtttgttctgggaggtatggggggaaaaaacccaagaattaaaatttttagaaaagcaacaaatagaaaataataac

SEQ ID NO: 27963 - DNA, 151 bp, Homo sapiens
  misc_feature 6, 14: n = A,T,C or G
caagantggaaganttggaggccaggtgcggtggctcatgccctgtaatcccagcactttgggaggccgaggcaggtggatcacttgaggtcaggagttcaagaattaacctggccaacatggtgaaacccccatctctattaaaaataca

SEQ ID NO: 27964 - DNA, 466 bp, Homo sapiens
aatctcagggagctgcttctcaggttaccatgtgggcacaaagagagaaacatatggcatctgttttgacaggtttttatctggctagatgaggtgttcctgtattttaacttagtggtcttccctctaggttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatga

SEQ ID NO: 27965 - DNA, 137 bp, Homo sapiens
gggtgtggtgctgtgtgcctataatcccaggttctcgggaggctgaggcaggaggattgcttgaacccaggagacagaggttgcagtgagccaagatcgtgccactgcactccagcctgggtgacagagcgagactc

SEQ ID NO: 27966 - DNA, 114 bp, Homo sapiens
  misc_feature 6, 13: n = A,T,C or G
ggagangaaagangaggaagctgagtcagctacgggcaagcgggcagctgaagatgatgaggatgacgatgtcgataccaagaagcagaagaccgacgaggatgactagacagc

SEQ ID NO: 27967 - DNA, 378 bp, Homo sapiens
ggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttac

SEQ ID NO: 27968 - DNA, 209 bp, Homo sapiens
atttaaaacagtgtttagagggaaatttatagcactaaatgcccacaagcgggaaagatctaaaatcgacaccctaacatcaaaattaaaagaagtagagaagcatgagcaaacaaattcaaaagctagcagaagacaagaaataactctaagatcagagcagaactgaaggagatagagacatgaaaaacccttaaaaacaaacaaac

SEQ ID NO: 27969 - DNA, 300 bp, Homo sapiens
aaggatggaatgcataaaatccttccccagagcaagcttctcccacttcttgaaaggctttatttttatatagcctctggaagccagacaaagtatcacttagaaagcgagcctcacagggcggctctggagagatctgaaggctgcgttcataagttcagaaagaacaaagtttatgctttaggccgctagaccgtaagctctttgagttcagtttttatcttcattgtatttcaagaactgtgcaagtatctggtacctggaatatgctcaataaatgtttgaataaagattaaaaac

SEQ ID NO: 27970 - DNA, 477 bp, Homo sapiens
atggccggggagcagaaagaggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttg

SEQ ID NO: 27971 - DNA, 476 bp, Homo sapiens
atgtcatcctttatctacattggtccctgtagtgaggatcatggagtagatgttgctgggagagtgagtatatgtgaaaaaaatgtgaaggtatttggtgctgatgaagcaatatgccctactgggcaggggagaggcacagaataagaattcttgccatgtggatgaactcattcaaacacaatgactgctttatgagacaatagatagatttctacctcttctcacatgtacagagaaaatatttccaaagtctccggaatatttacatgtattactatttaatataaacttgcaagtctttttaaatgtgtttaaaactatcacagtactaaacatgaactagatgcataataaatgctgaaagtaaaaagcctgaattatttaagtgaaaagagaaaaagatttagatcccaaataaatgtatgcgtttgtgtgtttgtgtgtgtgcgcgcatgtttgctgggcatgtactt

SEQ ID NO: 27972 - DNA, 149 bp, Homo sapiens
cgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgac

SEQ ID NO: 27973 - DNA, 477 bp, Homo sapiens
ggcggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgc

SEQ ID NO: 27974 - DNA, 481 bp, Homo sapiens
atggccggggagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaac

SEQ ID NO: 27975 - DNA, 467 bp, Homo sapiens
gtaggtgaaaatgcccagccaatcctagaaaataatattggaaaccgaatgcttcagaatatgggctggacgcctgggtcaggccttggacgagatggcaaggggatctctgagccaattcaagccatgcagaggccaaagggattaggacttggatttcctctaccaaaaagtacttccgcaactactacccccaatgcaggaaaatccgcctaagaaaagcaaagaagaaatgttttacagactttattcactatgtcccattgttctaaaatgataacatgacttctgtttttgaagcaaaaatctacattgcctcaaacacatcactctagcttccttactgcatacagtcctgccatagtgagagaaatgggatttcatcacaattcatggtgctaaaatgaaaacctctgcactttaatttttttcagtaatttccagctatttctaggtataaagagcag

SEQ ID NO: 27976 - DNA, 318 bp, Homo sapiens
  misc_feature 13: n = A,T,C or G
aaacatatgagantataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaac

SEQ ID NO: 27977 - DNA, 182 bp, Homo sapiens
gatgctgaaggattgtagacacttacccacaggctgccaacatccagtcatttgccaaagctaaaagcatatggcattttcccgcaggctacttgtcttttatttttcacaggagtttcatcacctaatttagcactatctgcaaagatttgggatagcaaataaaatcttccttcctgttt

SEQ ID NO: 27978 - DNA, 387 bp, Homo sapiens
ggacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatac

SEQ ID NO: 27979 - DNA, 468 bp, Homo sapiens
  misc_feature 10: n = A,T,C or G
tgttccaagnacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccgccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaactt

SEQ ID NO: 27980 - DNA, 291 bp, Homo sapiens
gtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgtagtcta

SEQ ID NO: 27981 - DNA, 224 bp, Homo sapiens
gtggctaccctgccagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggtttt

SEQ ID NO: 27982 - DNA, 465 bp, Homo sapiens
gaggtcctgggtgaggtagggttggatggtgcttgccgcgtatcatggctgcctccggaaaactcagcacttgccgtctccctccgttgcccacgattcgagaaatcattaagttgttaagactgcaagcagcgaagcagctatcacagaatttcctcctggacttgaggctgacagataagattgtaaggaaagctggcaatctgacaaatgcttatgtttacgaagtgggccctgggccagggggaatcacaagatctattcttaatgccgacgtcgctgaacttctggtggttgaaaaggacactcgatttattcctggattacagatgctttctgatgcagcacctgggaaactgagaattgttcatgggagatgtcttgacatttaaggtaagaaaaggctttttcagaaagtcttaaaagaccctgggaagatgatcctccaaatgtacatattattgg

SEQ ID NO: 27983 - DNA, 365 bp, Homo sapiens
atatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggtttttttcgtgggttggggggtaacctttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgattt

SEQ ID NO: 27984 - DNA, 122 bp, Homo sapiens
gaatgccccaactaaatactaccgtatggcccaccataattacccccatactccttacactattcctcatcacccaactaaaaatattaaacacaaactaccacctacctccctcaccaaag

SEQ ID NO: 27985 - DNA, 350 bp, Homo sapiens
agggaagcctgtgatgactacagactttgcgaacgctacgccatggtttatggatacaatgctgcctataatcgctactttaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactt

SEQ ID NO: 27986 - DNA, 470 bp, Homo sapiens
  misc_feature 36: n = A,T,C or G
cgtaggagcctctctccctactgctgctacacaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggctta

SEQ ID NO: 27987 - DNA, 371 bp, Homo sapiens
ataattaaaatttttatagaattaaactgacagttctctcctacccattattttggtgaactatactatatttcaaatcctgttttccaacagggttctgtatttacatctgtaaacttatttttcaatttatttctgtttgattttttgaaacagggtctcaccctgtcacccagggtggagtgcaagtggtgtgatcttggctctctgcaacctccgcctcctgggctcaggtgacccttctacctcagctactcaggaggctgaggtgggaggatggcttgagcccaggaagtcgagggtgcagtgagccatgtttgcaccactgcactcctgcagtctaggtgatggagccagccagaccttgtcct

SEQ ID NO: 27988 - DNA, 280 bp, Homo sapiens
acatgaggtttttctgagagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaac

SEQ ID NO: 27989 - DNA, 112 bp, Homo sapiens
tagaatcttagttaactttaaatttgcccacagaaccctctaaatccccttgtaaatttaactgttagtccaaagaggaacagctctttggacactaggaaaaaaccttgcg

SEQ ID NO: 27990 - DNA, 385 bp, Homo sapiens
aacgaaatgaaggcagaaataaagatattctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaacccttcaaaaactcaatgaatccaggagctggttttttgaaaggatcaacaaaattgatagaccgctagcaagactaataaagaaaaaaagagagaagaatcaaatagacac

SEQ ID NO: 27991 - DNA, 472 bp, Homo sapiens
  misc_feature 21: n = A,T,C or G
agggcggaaaccgtaaatagnaaataaaaacacacaaaaatatatacatatatatacctacacacatctatacctacaaatgtttatatatgtatatacacacatatacacacacctgtataatatacacatattatatatattatttatttatttaagtttttattctttgtttttttgaggcagagtctcgctttgttgcccaggctggagtgccatggcgtgaccatagctcaatgcagcctcgacctcccaaacacaagcaaacctgcctcagcctctcaagtagttgcgactgcagacatgcaccaccacgcctggctaatttttgttttattctttgtacacatggggatcttgatatgtacctaaggttggtcttgaactcctggcctcaggtgactttcccacctctgtaatcccagcactttgggaggccgaggtgggtggatcacctgagatcaggaattcg

SEQ ID NO: 27992 - DNA, 447 bp, Homo sapiens
  misc_feature 442: n = A,T,C or G
cactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtattttttattttcctgtgactgnttttg

SEQ ID NO: 27993 - DNA, 456 bp, Homo sapiens
ggcaggaaggttttcaacctagtcacagagcagcacctaccccctcctcctttccacacctacaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaat

SEQ ID NO: 27994 - DNA, 454 bp, Homo sapiens
gcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgc

SEQ ID NO: 27995 - DNA, 468 bp, Homo sapiens
gataggtgtgcaacagatattttttgaattgataaatgagtgaatgaatgtgtgtttatgtcagatcctataagaaaaagaatatacaagtacagaagcaattctggttttgaacagagcagattgcaaaagatacttttaaattaaaactataaaaataactgatgtatcagtattcttttaaaagttggttttattttaaaaattgtagataccaatgacattaataactaactaattcttctggtttcttttaaaatctcttttccaaaatgttcaaggatgtttgacttttgtttttttttctctctcttttaatcataaataggtataaacagtgctttaaatactctgagtactaaagaacaaaattatgacaaaaagaaaatgaccatgactaattttcaatactatctgttggtagcaaccagatacacttgcattctaaccagtggcatgtatttgtac

SEQ ID NO: 27996 - DNA, 468 bp, Homo sapiens
  misc_feature 24: n = A,T,C or G
tagatgaaccaccaacacaaaatngtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactctcccggaagaagttggtcatctaagttttaatagttccagtagttcagaggccaattttaaactggagccaaatagtcctatgcatggtggcactcttctagaagatgttgtgggagggagacagactactccagaatcagactttaatttaca

SEQ ID NO: 27997 - DNA, 201 bp, Homo sapiens
agtaaaagactggttaatgataacaatgcatcgtaaaaccttcagaaggaaaggagaatgttttgtggaccactttggttttcctttttgcgtgtggcagttttaagttattagtttttaaaatcagtactttttaatggaaacaacttgaccaaaaatttgtcacagaattttgagacccattaaaaaagttaaatgagg

SEQ ID NO: 27998 - DNA, 466 bp, Homo sapiens
gaattccaaagattcgcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacattcatcttctgggtacatttgatctgactggaattcctcctgctcctcgtggggtcccacagattgaagtcacctttgagatagatgtgaatggtattcttcgagtgacagctgaagacaagggtacagggaacaaaaat

SEQ ID NO: 27999 - DNA, 368 bp, Homo sapiens
ggcagatttgtggtgcgttctgagccgtctgtcctgcgccaagatgcttcaaagtattattaaaaacatatggatccccacgaagccctactacaccaaagtttaccaggagatttggataggaatggggctgatgggcttcatcgtttataaaatccgggctgctgataaaagaagtaaggctttgaaagcttcagcgcctgctccaggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatg

SEQ ID NO: 28000 - DNA, 176 bp, Homo sapiens
  misc_feature 176: n = A,T,C or G
agaaaaggtgttggttgatatagacagcaggacggtggccatggaagtcggaatccgcttaggagtgtgtgtgtgttatggggctatctatgctttgggtggatgggttggagctgagatagggaacaccattgaacgatttgatcctgatgaaaataaatgggaagtagttggtn

SEQ ID NO: 28001 - DNA, 473 bp, Homo sapiens
  misc_feature 14: n = A,T,C or G
gctctttccctaancgcctgagtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtaagattctctggtcattgagcatatccaagtgaacaaagcacctaagatgcgccgccggacctacagagctcatggtcggattaacccatacatgagctctccctgccacatt

SEQ ID NO: 28002 - DNA, 155 bp, Homo sapiens
  misc_feature 27: n = A,T,C or G
agggaacaggtgctgatgggcccaagnagtgacaagcatacacaactacttattatctgtagaagttttgctttgttgatctgagccttctatgaaagtttaaatatgtaacgcattcatgaatttccagtgttcagtaaatagcagctatgtgt

SEQ ID NO: 28003 - DNA, 195 bp, Homo sapiens
  misc_feature 180, 181, 185: n = A,T,C or G
gggcattgtggctcacgcctgtgatcccagcactttgagaggctgaggcaggaggactgcttgaagccagggattcaagatcagcctgggcaacatagggagactgcatttctatttaatttttttaaaaaaagactattttaaaactattttaaaactaaaaatagattaaatacttgnncctnaagacttacc

SEQ ID NO: 28004 - DNA, 345 bp, Homo sapiens
aatttcaaaaactaccgttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactc

SEQ ID NO: 28005 - DNA, 467 bp, Homo sapiens
  misc_feature 192, 333: n = A,T,C or G
ggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggngattctgaaccttgcctcatagcttaaagtataaaaaagattcaagagcagtgaggtttgttctttccagtgaatggtggactgagtggtgcgaggtggagggctaacaagaggaaagaactacattcttcagaatacagngatgaaaattcattttgaaactcaaatattttcattttggatattctcctgtttttattaaaccagtgattacacctggccatccctctaaatgttctaggaaggcatgtctgttgtgattttgatgaagacag

SEQ ID NO: 28006 - DNA, 122 bp, Homo sapiens
  misc_feature 119: n = A,T,C or G
ctgaaggaatatggatggcattgaaggccattatccttagcaaatgaatgtaggaacgaaaaaacaaatgccacattctctcacttgtaagtgcaagctaaatgatgagaacacatgcncac

SEQ ID NO: 28007 - DNA, 471 bp, Homo sapiens
  misc_feature 443, 447: n = A,T,C or G
agtttaaaatttttcctatagggaaggtcagggccagatgtgttcaatggttggttctactagacattcaaaaaaataataattcaagtctacacaaactttcctgagattagaaaaaataaagaagagtccccccacctgtttcttactttatgagaccacacctaaaagatagaagactgctttgcaaccaagaaatccttcatgaacacctctttaatcacaagtcctcaactccaaggttaactttatttcaacttttataatacttttcttacttttcttcatagctttaccacccatgtattcattcctaaaaaatacacagttttgtctgattttgaattttatgtgaatggaattgtacatatctgtgtttgtgtcttccttgttttactcaatactgtttctgagatcaatcatattatttgtaatatttttgnttanggatttttgcatctctatttcagt

SEQ ID NO: 28008 - DNA, 472 bp, Homo sapiens
gtttatagaaatgctcttatgtattggtttagtaatcctggtttatagtttattttgaacttgatttatgaacagaagtactactctcatttattaaggctgatgggtttctctccccaccctctcttcagaactttctgctttgtcctttctaataaatttgggagtgtggaacacactgtccatgattcttccttccaacattagattttagactaattaacagaagaaagcaagcatctttcaaaaacttgactttaagtacttgggtatatataatcaggaccattaaaaagaacacgatgtttagtgcatctctcttctcttagtgagcacagaaacttctcttggctgtttccagtgttgaggcaggccaagtatagctccaggcactgaaatcttggagactaaaaggccatatctttttgtaggaaagtgaggaccccttcttgttcatcagttctgtttttgt

SEQ ID NO: 28009 - DNA, 467 bp, Homo sapiens
atgactattggtgtcgggggagatgtttcccctctagattctgggggaagaataagagggccgtgatgagtcatagggagcagtgggctgggaggcttcttcatagagtaatttgaggattaactatgaagagatgcataaagggttcagcacggtacctgcccagtaaggggtagttctgttttcatccctaaagatggatgattctggctgaggacttatttgcttctctgtttcactgactcctactagttttcttatatttatctcatgggagatgacaggagatgactcataccaagtagcaaaaagagccagcacgctggctccggtaaaatgttgtgtggggcagtaaggagctaataataataataaggtataacagctacggcttcacttaatttacactttttatgtcccagccaatgggctaaaagtttaggtgtgttacctcagtcatttgatga

SEQ ID NO: 28010 - DNA, 467 bp, Homo sapiens
aagtcaaggatgtatgtggtaatctctacaaagaaaagaatggtaaaaagtgtataattactaatgaaataataaaaaccaagcaacaagttaaaaagaaagaaaacagaaaaaggaacatagaacatgtaggacaaataaaaagcgaatagaaagtatatttcaattcaaacattaaattttacattaaatataaacagcctaaatgttccaattaaaagacaaaaattgttaaactgcattaaaaaactccacaatatgccactaataggaagtatactgaaaatataaaaatatagaaagacagcaaaacatatattttgcagacattaatcaaaagaaagcaattacatgcaggagcagaaaaccaaagaccacatgttctcccttataagtaagagctaaacattgggtactcatgggcataaagatggcaacaatagacatgggaaagaaggcagggagag

SEQ ID NO: 28011 - DNA, 331 bp, Homo sapiens
  misc_feature 7: n = A,T,C or G
atcaagnacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgact

SEQ ID NO: 28012 - DNA, 370 bp, Homo sapiens
gagtagggcttggcgtggtggctcatgcctgtaatctcagcactttgggaggctgagatgggtggatcatctgaggtcaggctgttctcaaactcctgacctcgagtgatcggcccacctcagcctcccaaagcgctggaattagagtcatgagccaccacaccaggtcaaatcatgcttttattatctagttaatctggaataaattgaacagtatgtgccattgctaaatggggaaaaagttgaaatttgcctttatgcatataacaatcaacattaaatattgtgttaaaactacactttgtaaaaattttcatagtaagctgatctaaaattacatattttaaaacttaaaataatcaacattaac

SEQ ID NO: 28013 - DNA, 340 bp, Homo sapiens
aggatgaaacaatttggagaagatagaagtttgaagtggaaaactggaagacagaagtacgggaaggcgaagaaaagaatagagaagatagggaaattagaagataaaaacatacttttagaagaaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaaatatagaagatagaaaaatataaagtc

SEQ ID NO: 28014 - DNA, 471 bp, Homo sapiens
gggttgtgatgagaggataggggagataatatcggcatcaaattctttgggtatctctctaagaattaaataatcttttctagcttaatattttaattctaattcaaacaactctgaggttttggtttcattagtaatagttgaggaataatatactagcaaagaatggcctaatgtttgtcataactgttaatggatgaaattttttaaagatacaaccatgataaccattataaatgatctatgatcaaaatctaaagtgatgaattatttgtaggaatgtcttcctaatggggaagaattgcataggagcattatgcaaatctacacaagcttttataaatgttgctgctgggtagctccacagtgtttcataaggccatcctgtttcccccaactcccccatttttggtttgtttctttttaatatttgttgagtacttacgtgtttatctaacagttcacttccat

SEQ ID NO: 28015 - DNA, 472 bp, Homo sapiens
gtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgccgaaccctgtgttcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgcgctccacccttttctgagagttatttacagccagaaagtgtgggctgaagatggttggtttcatgtttttgtattatgtatcctttttgtatgggaaagactatattttgtactt

SEQ ID NO: 28016 - DNA, 333 bp, Homo sapiens
agagaggaaccgtatctagtttacagttaatggcatgctgctatcagttttgttttttaatacaaataagttacatgaaaagtaactacagcatgatccaaagatctatcttgacttggccttaagctttgagaatgcaatgcattccctccacattttccctgtatttcctaaatttttaaaaaggtaacagctttagacccagcttttagttgttactatcttgctttataaatgtaaacaaagactactgctgtcattggcctactgaatagcctccatagtcaacaagacactagatagttcaatggacttgtgcatacctctgttttc

SEQ ID NO: 28017 - DNA, 177 bp, Homo sapiens
atcaagtctgctccttgtagatgaagaaactaattacagtataagggagggggaaagagaatagagtgtgtatgtgtgtgtttgggtggaggtttggtggtaaggaggaaatgaaaatttcagtaacatttctttaagtgaagaaatgacacgggaattaaagagtaggatgacagg

SEQ ID NO: 28018 - DNA, 418 bp, Homo sapiens
  misc_feature 12: n = A,T,C or G
acagcccccagnactaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttcttttt

SEQ ID NO: 28019 - DNA, 111 bp, Homo sapiens
  misc_feature 24: n = A,T,C or G
ggggaatcagggttcgattccggngagggagcctgagaaacggctaccacatccaaggaaggcagcaggcgcgcaaattacccactcccgacccggggaggtagtgacgag

SEQ ID NO: 28020 - DNA, 229 bp, Homo sapiens
ggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgattcg

SEQ ID NO: 28021 - DNA, 470 bp, Homo sapiens
  misc_feature 3, 5, 9, 33: n = A,T,C or G
atncnaatnactttttctttgtatccctatttnatgagcagtcagtctcaagaggttactgcacttcagttctaactagacctttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtaagttgtacatttttaaactaagggcaatacactgacatggttatgtgcgtaaaaattttgacttaaagaactggaagtttatatacacctggactataagaaacagaagaaaatcagtccacattttacagttagcagagaatcct

SEQ ID NO: 28022 - DNA, 201 bp, Homo sapiens
  misc_feature 13: n = A,T,C or G
tatggccgggganacaggatccggagctggtgctgataacagcggaatcccccgtctacctctctccctggtcctggaacagcgctactgatcaccaagtagccacaaaatataataaaccctcagcacttgctcagtagttttgtgaaagtctcaagtaaaagagacacaaacaaaaaattctttttcgtgaagaactcc

SEQ ID NO: 28023 - DNA, 475 bp, Homo sapiens
atttcaccttcttctaacaacgtattctagtagtggtttactttgttcctgtctttagcaaggtaataaaaggaatttgaagctttgggtaacttattctgtcagatcttactagtaatcatactttcatgtatcaagtgatatggcaaattatgtcaacaagaaaatgtccccaaagctcttaggtattttgatatgtcaaatcatgtttttgaagattttaatgaaaccataggcaacaaaaacaagtatggttgatatcttgtccaaacacaattctagatttatttgatacacagcacaaatgtaaattttggtaaatttcatttggtctgaacttcttcctaatgaaagtgaaaagttcttatctgctcaatatcctgcacagcatgtatataacactgctaaaaaggggtataacttgcttaagtttgataattggatgctttcttaatgaacactttttggttacttt

SEQ ID NO: 28024 - DNA, 180 bp, Homo sapiens
  misc_feature 4, 12, 38, 45, 75, 94: n = A,T,C or G
gaanctcggccntttaatggcccgggagccccaggccnagaagancctccccttcggtgcccgggccgcaggaanctgtgtgtgtccctacacnaatggtgcctattctgtgtcaaaccaccctctgtatttttttaaaacctcaattgatattaaaaatgaaaaagattattggaaagt

SEQ ID NO: 28025 - DNA, 256 bp, Homo sapiens
  misc_feature 12, 37, 44, 95: n = A,T,C or G
aataaaacaccntcaccactacaatcttcctaggaanacattantgaacgcacctctcccctgaactctacacaacatacttttgtcaccaagancctacttctaacctccctgttcttatgaattcgaacagcatacccccgattccgctacgaccaactcatacacctcctatgaaaaaacttcctaccactcaccctagcattacttatatgatatgtctccatacccattacaatctccagcattccccctc

SEQ ID NO: 28026 - DNA, 409 bp, Homo sapiens
  misc_feature 7, 11, 30, 31, 33, 42, 52, 64, 97, 134, 144, 147: n = A,T,C or G
ctcggcntttntgggcccgggggaaaaaanncnttgtagagngtgtaaaaantttaaccacccnagtaggcctaaaagcagccccccaattaagaanagcgttcaagcctcaacaccccacttacctaaaaaantcccaaacantantaactgaactcctcacaccccaattggaccaatctatcaccctatagaaagaactaatgttagtataagtaacatgaaaacattctcctccgcataagccctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttact

SEQ ID NO: 28027 - DNA, 327 bp, Homo sapiens
  misc_feature 3, 24, 27, 41, 46, 53, 63, 105: n = A,T,C or G
ganctgtctcttcctgggtaaaantantaaaaattaaagangccantccctcntacttgttanaaaaattcaaacaatgccccttgggtctgtagaattaaatanaatactcttcactgacaacctaatcctctcatctacctgtcactaacttcccaaagaagtgttgacaagttaaagcatatgttctagtaagtaatttttctattaatttatatacatatgtaaacatacacatacatttacaaaatgcaatcttcctttatgtgttattttgtgactggcttttacacataaaatatatcttggagatctttgcctatctgt

SEQ ID NO: 28028 - DNA, 185 bp, Homo sapiens
  misc_feature 1, 9, 18, 29, 30, 33, 34, 112, 117: n = A,T,C or G
naatgagantcttctgtnttctggagaannccnntcctgatttcccacaaactgcctacactcagtataactgcatttctagtttctctactagtgcaatagagcattagantctantaaattcttacttgtctaagacaagtaaatctgtgttaaacaagtagtaataaaagttaattcaatct

SEQ ID NO: 28029 - DNA, 402 bp, Homo sapiens
  misc_feature 6, 25, 29, 59: n = A,T,C or G
tcggcntttttggccgggatagaangagnaaatatgagaagcagctactttagaagacnaacataggaggaaagcttcgtgacattggagttggcaatgctttcttggatgtgacaccgaaaatacaacaaaagaaataaatgataaattggacttcaccaaaacttaaaacttttgtgcatcaaggaatactaccaatggcgtgaaaaggaaatccacagaatggaagaaagtatttgaaaatcgtatatccgataaaggactagtatccagaatatataaagaactcctacaactaagccacaaaacaaaaaaaacaacccagtgaacagacatttttccacagaagacataccaatggccaagaagcacaggaagagatgcgcagtgtcactaatcatc

SEQ ID NO: 28030 - DNA, 498 bp, Homo sapiens
  misc_feature 18, 20, 37, 94, 102, 125, 131, 156, 180, 451, 462, 483, 493: n = A,T,C or G
ccccgggacctcggcccntntggcccggggaggcccntgaggccgcccgcgccggggccttctgctgagggggcaggccggagccttgaggaanccgcaganaagtttttttctctttgaaaganagaganttaactaccaacctaccttaaaaantctagtcaataggttacctaagantattgcttagcgttaagtttttaacgtaattttaatagcttaagattttaagagaaaatatgaagacttagaaagagtagcatgaggaaggaaaagataaaaggtttctaaaacatgacggaggttgagatgaagcttcttcatggagtaaaaaatgtatttaaaagaaaattgagaagaaaggactacagagccccgaattaataccaatagaagggcaatgcttttagattaaaatggaaggtgacttaaacagcttaaagtttagttnaaagttggganggtgattaaaataattttggnaaggcgatcntttta

SEQ ID NO: 28031 - DNA, 435 bp, Homo sapiens
  misc_feature 11, 414: n = A,T,C or G
gctttcctttngcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgccggagggcctgctatggtgtgctgcggtccatcatgganaagtggggccaaaggctgcga

SEQ ID NO: 28032 - DNA, 471 bp, Homo sapiens
gagctaaaggaggatggttgaacccatcacaaggaagctaaaaaccttgaaaaaagattagacgaatggctaactagaataaacagcatagagaagaccttaaatgacctgatagagctgaaaaccatagcacgagaacaacgtgatgcatgcacaagcttcagtagccgattcgatcaagtggaagaaagggtatctgtgattgaagatcaaatgaataaaatgaagcgagaagagaagtttagagaaaaaagagtaaaaagaaatgaacaaagcctataagaaatatgggactatgaatgggtgggttgcccctccacacctgtgggtgtttctcgttaggtggaatgagagacttggaaaagaaagagacacagagacaaaatatagagaaagaaaaagggggcccagaggaccggcattcggcatacggaggatccacaccagcctctgagttcccttagtatttat

SEQ ID NO: 28033 - DNA, 258 bp, Homo sapiens
  misc_feature 199, 203: n = A,T,C or G
agtttcgagacaggcatcactttaaggctgaagtacattttagaaagttagggactggttctgtggcggggaagttgagctaaatatgcagttctattttaattttcactttatgccaaggcaaaagcattgggagatagactataaatgtataagtaagtcagtgcaagaaatagccccttgcaaaatgcagatttangggngctaaaattttctcacttcctttaatgcccatgaataacccctgatcgagttctg

SEQ ID NO: 28034 - DNA, 104 bp, Homo sapiens
aggaggctgaggcacaattgcttgaacccaggaggcggaggctgcagtgagccgagatcacaccactgtactccagcctgggcaacagagtgagcctctgtctc

SEQ ID NO: 28035 - DNA, 500 bp, Homo sapiens
  misc_feature 5, 9, 41, 44, 53, 59, 106, 115, 368, 399: n = A,T,C or G
gtttnaccnagtcttgttaaactcctgacctgtcagtagangangactctccntgtganaaacctgagtggctttccacaggcttcattttccttaccctcttcantgggtacantccatgtcaacctcatagaattcttgtaaggattaagggagataatgtatataaggctgctgtcaggacgttgcatagagcaggaactttgcgtttgtcctgcctccctctcttacacgtgacaagagttacatgaccttggcaagacacagtctctgtggagctgtttcgtagtctgtaaaataaatgactggcattagatattctctaaggtcctgctggtgaaacaaaatctttttaagttcttatgtgnattttagtttccacggaaagtaatttttagntttcctttggttcctaactgtaattattctcacttagttgcatgaatgcagaagggtatcctattgttaaatttttgggaaacaatcctctaatttgaatt

SEQ ID NO: 28036 - DNA, 157 bp, Homo sapiens
  misc_feature 2: n = A,T,C or G
cnactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgctt

SEQ ID NO: 28037 - DNA, 498 bp, Homo sapiens
  misc_feature 1, 18, 28, 93, 408, 410, 446: n = A,T,C or G
nttggcccggggtatttnagaaatgagnaccagctggatgaaatcttatgtaccctgtcacctcagctttagcagttattcagtaaatggccnacgttgtttcagctatacctcccctctcctccactgatagtcttttgaaggggaatacaattgttttgtggcctccagaaagggataagtttatgagcaacgggtagatcgttgggagagacttgagtttcctgtcaggaagcattcttggtgcataagtcagaggtgatatgaatgccgtggaagggggtggcttactgtctggagaactcgagaagatgggaatgggcactgtccagtattgtggctacttccacacatggttctttaaatttaaaattatggttgatttaaaaatttaaatatttttcaagntncctcagccattactaatcgtatttcaagtgcttaanctgccacatgtgcctaatggctgcaatattggacagcatgacataggacatc

SEQ ID NO: 28038 - DNA, 471 bp, Homo sapiens
ggacagtgtaagaaggccatctacaatcaagattgagagtggctctaacaagtgccatttttccttgttagctttcatttctcagccctttacaagattaaaatagtctgcagtttaatctctccaaagctttacggacagtgattctgtcctaaacaagacagtgactccaggatttctgaagactattgtggaagaagcatccattaaggccaagctataacatcagaaatggtgaatgaatacaagaaaattcttttgctgaaaggatttgagctcatggatgattatcattttacatcaattaagtccttactggcctatgatttaggactaactacaaaaatgcaagaggaatacaacagaattaagattacagatttgatggaaaaaaagttccaaggcgttgcctgtctagacaaactaatagaacttgccaaagatatgccatcacttaaaaaccttgttaac

SEQ ID NO: 28039 - DNA, 359 bp, Homo sapiens
  misc_feature 298: n = A,T,C or G
gattgttagtggaacttctacccgacacttacatgccatggccttctacgttgtgaaaatgtacaaacacctgaaatgtaaacgtgaccctcatgttaagatagaagggaaggacactgatgactggctgtgcgtggattttggcagcatggtgattcatttgatgcttccagaaaccagagaaatctatgaattagagaaattatggaccctacgttcttatgatgaccagttagctcagatagcacctgagacagtacctgaagacttcattcttggaatagaagatgatacttcntctgtgactctagtggagttaaaatgtgaataaaatattttatgcactgcgttagtcattt

SEQ ID NO: 28040 - DNA, 308 bp, Homo sapiens
  misc_feature 38: n = A,T,C or G
gttgatgttaactgagctactagagatattcttatttnctaaatgtaaaatttggagtaaatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcga

SEQ ID NO: 28041 - DNA, 471 bp, Homo sapiens
ggcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaactggccgaggagaagcgcgagggctacgagcgtctcctgaagatgcaaaaccagcgtggcggccgcgctctcttccaggacatcaagaagccagctgaagatgaagtgg

SEQ ID NO: 28042 - DNA, 473 bp, Homo sapiens
tgcttttaaacctgaaaaaaaatgaggattgttcttgttctgggtggagattgaggatttaaaaagaaatcattactatatccatgtaagttaaaacttgaattcaaattctagccttgaattcatgccctacctttccttctatgatctctacacaatcagtggacatttatagcaaaccagttagctttgttcccaatcctcattttatggagtaaagaaaatacctctctgcaattttgagctatgcccctgatactcttcctgagaaaaacatgtatttgttatatctcccgttaagcccgtctgctcacttgaataaagggaatattagttttgaagatacaattttctggtaattttaggagacaaaaggagtcattttgataatgtaaaagagtcaacagaaattataattatatttgagcctttatgccaatttgtcctcatctaagatttcaggggaaaaaatt

SEQ ID NO: 28043 - DNA, 128 bp, Homo sapiens
gaagatgagaagaggagagggggcacgtactgaggtggatcaggggtgcctcttgtttttggtgcctaagactctttggcaatctggtgaagcctctaagccccttctcagaataagattttttcagg

SEQ ID NO: 28044 - DNA, 471 bp, Homo sapiens
acatggaaatgactctctgcagcccagaacacagtcattttctgaattatcccagtctctcatgcgccctggattcctccagatgccttatatctcttgtgcaaagttgtctaaaatttggttcccagcttccaagccttgccttttggccttcctggaagtatttttgttgatgagtcgtctgtcattattctctaaaatgatttgctttttgtttctttcattcctatttccaccccacatatacacacatgcttcttaacttaggggattacatgccaataaatctattgttgaaaatgcactaatactatcgcaaagatgaaaattcacaggctgaaccgttgtaagtccatatgctcctcaacttacatgtgtgatggagttatgcccaaataagtccatcgtcaagttgaaaaatcaaaatcaagccatcttaggttgaggaccattttgtttgtacctccaaag

SEQ ID NO: 28045 - DNA, 273 bp, Homo sapiens
atttgatttcttgggtgacattaggttcctggtcagatatcctgaattatatcctgaattgtagatatttgtgtaagaattcaagtctttggaaagtaagcaatgaaaatatcagaactgagtaggaacaagttttctttccatggctttctttgttaaagcagcctgattaatatgccttgtgagggataccccatagcaaaatgcttattgattatcccattatcagaatttctaagaaattaataaagtcacagtttgctcaatgatttg

SEQ ID NO: 28046 - DNA, 229 bp, Homo sapiens
  misc_feature 13, 29: n = A,T,C or G
attgacaaaatcntctcttaatgacaatnagcctcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaag

SEQ ID NO: 28047 - DNA, 363 bp, Homo sapiens
  misc_feature 38: n = A,T,C or G
acatgatgaatgcacaagcctcagtagccaatttgatnactggaataaagggtatcagtgatggaagatgaaatgaatgaaatgaagtgagaagagaagtttagagaaaaaagaataaaaagaaatgaacagagcctccgagaaatatgggactatgtgaaaagaccaaatctacgtctgactggtgtacctgaaagtgatggggagaatggaaccaagtttgaaaaactctgcaggatattatccaggagaacttccccaatctagcaaggcaggccaacattcactttcaggaaatacagagaatgccacaaagatactcctcaagaagagcaactccaagacacataattgtcagattca

SEQ ID NO: 28048 - DNA, 471 bp, Homo sapiens
  misc_feature 410, 447, 450: n = A,T,C or G
gttttagtctggcactaggaataattctgcaaaagaaaacatggaaaaggaaaagccagtcaaacgtaaaatgaagtcatctgtactcccaaaggcgtccactctttcaaagtcatcagctgtcattgagcaaggagattgtaagaacaacgctcttgtaccaggaaccattcaagtaaatggccatggaggacagccatcaaaacttgtgaagaggggaccctggaaggaaacctaaaggtagaagttaataccaatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgnaagggaaggatttgttacagaaaaagaatcgtgggangtngggaagcccaaaaggaagatg

SEQ ID NO: 28049 - DNA, 173 bp, Homo sapiens
  misc_feature 10, 11, 28: n = A,T,C or G
aatttcggcnntttatggcccgggcatntgtggtgcacaccttgtagtcctacctacttgggaggtcaaggcaggaagaatcacttaagccccaggagttcaaggctgcagtgagctatgattattgccactgcacctccagccctgggcaacacagcaagacctggtctctc

SEQ ID NO: 28050 - DNA, 461 bp, Homo sapiens
  misc_feature 460: n = A,T,C or G
catgtttaaaaacaaaacacattcgagcattggacttttttaacttgttttcatctgtttatcatgacttttttatttctggtgtagagtccacattatttagtttgttgtacttttaaatttcaaagttcaaatctgaagaattagcgtttgtgatttcgggataccatgcagtggttttaatcccaggaaaaaaactatcaccaaaagttcgtttgattctcattatgtaactttgtagaaccatcctttctagatgggtccaccacagtgaatttgtaactttgaagtcaggatagaatatcattagattatctgtgagatagcattactatgttaggaccagcagagtttggggttggtaaaaataaatgtttgctctattactgggttacagacatttcagcatttttaggtttgggttttaaatcactaaaaatatttattccggattttgaang

SEQ ID NO: 28051 - DNA, 441 bp, Homo sapiens
gggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatggtttaagtcagcatgctcaggaaataaatggtggaattgc

SEQ ID NO: 28052 - DNA, 182 bp, Homo sapiens
agggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggaccct

SEQ ID NO: 28053 - DNA, 456 bp, Homo sapiens
  misc_feature 386: n = A,T,C or G
ggaaaacccttaatgcctactccatcttactcaacataagaaggttcatagttaatgaaagcattaaaagtgcaattactgtcaaaaaatctttcagaaaatataagcctttaaagtgaagaagagtatttattctgaagacaaccattacaaatatacaggaggtttattacacacattttgtactagaggaaaatcctgaagcagttgctcaagctttgctcaacatcagagaacttatattggagaagagtcctgcaaatgtaatgaatttggaaacactttaaaaaaaaaactgcagcttagaaaacagcagagtttatactaaaatatatttttgcagatgcagtaaacatgaaaaaatatttgaattcaaaattaattgnatgtaaatatcagaatttacagaataactaaggcactgacacttcagacattacattaataagagtggtg

SEQ ID NO: 28054 - DNA, 379 bp, Homo sapiens
  misc_feature 270, 303, 379: n = A,T,C or G
attgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctatttttcagttgtgtgtaagcaagttttttttttagtgtagganaaatacttttccattgtttaactgcaaaacaanatgttaaggtatgcttcaaaaattttgtaaattgtttattttaaacttatctgtttgtaaattgtaactgattaan

SEQ ID NO: 28055 - DNA, 202 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatttg

SEQ ID NO: 28056 - DNA, 401 bp, Homo sapiens
agtgactttgcttattcgagtccctaaaaatgtctgtattcttagattgtttttaagtagtatgctgcgtttcagctacttagctataagaactgtaacttcctctagctataagaactgtaacttcctcctcccacctttggagatgaaagaaagaaagttcaagctttatgtttttaatttaaattttctcttctttacttcagccctttctctttgctgcttgacaagccttttccattctgtttatcaaacactaatcttctctatgactctaatagctaatttctgactaacagacacattctaatccttaaaaatctgttgtaagtactttttctgagggataagtttatcttgatcagaatatgtacactcttaatttttctgttcaacattcc

SEQ ID NO: 28057 - DNA, 220 bp, Homo sapiens
gaagggaaattataaatgttctttgatttgcaagtaacttctagaaaattgtccaaccctttgttcacagtataattaaaaataagaaattataaatattctttgatttgcaagtaacttctagaaaattgtccaaccctttgttcacagtataattaaaaataagaaagtattaggttctttttctgactttcctccaaactgaaagttaaatgtctcc

SEQ ID NO: 28058 - DNA, 470 bp, Homo sapiens
  misc_feature 4, 28: n = A,T,C or G
agcnaggatattctcctgatttatattnactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttattaggatgacaaaccagaagattcgaatggattgaatgttacctgtgccagaattagaaag

SEQ ID NO: 28059 - DNA, 252 bp, Homo sapiens
aagaaatggcatctcttaacataatttaaaaatgaacaggttttaataaattattcttataccaagaactagatttcaaaatgaaggaaaattgcaattaatagataccaacactgagatgacagaggtgttagagttatttgacaacagttttaaaatagtcatgataaaaacgcttcaatgagcaaatctgaacacctttagaatgaatgaaaaagtagagaacctgaacaaggaaagagaagccctcag

SEQ ID NO: 28060 - DNA, 270 bp, Homo sapiens
cagaggaactataagaacacctttagaaataaaaatactgggatcaaactggcctgcaaaaccatagtcagttaattctttttttcatccttcctctgaggggaaaaacaaaaaaaaacttaaaatacaaaaaacaacattctatttatttattgaggacccatggtaaaatgcaaatagatcccggtgtctaaatgcattcatatttttatgattgttttgtaaatatctttgtatatttttctgcaataaataaatataaaaaatttc

SEQ ID NO: 28061 - DNA, 214 bp, Homo sapiens
  misc_feature 4: n = A,T,C or G
gatncacaggaatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagag

SEQ ID NO: 28062 - DNA, 472 bp, Homo sapiens
ggagtagggagacctgatttgagcactcttctggctgtgactttgaacacatgacctgggcacactgtacctcagctgtgtacatgtcaaatgagggcaataatattgctgcagagttgttgtgagaattaagtgagataacaaatttaaggtgcttggcatagtacctggtacatacatcatgtcaattaacgtttatatcaaattacccttttccatcttagaatattcctgtcatatttggtgcaaaattagggagtgctcaatattatcatctgtctaccttgctcataattatacttttcatacattgagaccactcagacactctttagtgtttttatgaagaaaccatttggccgggcatggtggctcaggcctgtaatcccagcactttgggaggccgaggcaggtggatcatctgaagtcaggagttcaagaccaacctggccaacatggtgaaatctcacct

SEQ ID NO: 28063 - DNA, 458 bp, Homo sapiens
  misc_feature 134: n = A,T,C or G
tattgaatattgtacattatgttgaaattgcaaccatttcacaccattgtaaagtccaaaaatcagaagctgaggactgtctgtacatgacattgaatcacatgaatggattactagggcctgaggggtgtccngttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatgggggtgtgtttatgaacttgttaatgttatttaatcatgcagatttccagtcagtgtattgctcatttactgacaaaaagggaaaatacgaaacacagaaagggaaaataaactgacttttaga

SEQ ID NO: 28064 - DNA, 473 bp, Homo sapiens
agcaaaagaaacctcaacagagtaaacagacaaccaacagaatgggagaaaatattcacaaactattcattcaacaaaaatctaacatccagaatctataaggaacttaaacaattgagcaaatgaaaaacaaccccattagaaaaatgagcaaaacacatgaacagacacttttcaaaagaagacataatcagccaacaaacctatgaaaaaatgcccatcatcactagtcatcagagtactgcacatcaaaaccacaatgagataccatctcacaccagtcagaatggctattattaaacagtcaaaagacaacagatgctggcatggctgcagagaaaaaggaatgcttatacactgttgctgggaatataatttaagtttggccactgtggaaagcagtttggaaatttatcaaagaaattaaaagagagctaccatttgacccagtgttcccattcctgggtataaat

SEQ ID NO: 28065 - DNA, 473 bp, Homo sapiens
gctaaacctagccccaaacccctccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacactaggaaaaaaccttgt

SEQ ID NO: 28066 - DNA, 387 bp, Homo sapiens
acttttacaatgtataggaaacagttttgttctcatttttcatataatatattgatattaataatggctattagtcaagggtattataaaaataattattaaactgaaatacttgttgaatgaatagatgcagcaaattacatagttatatatttaatttcaattgaaagtgacaagtgctcagtttggcagcacatatactaaaactggaatgatacagagattagcatggcccttgtgcaaggatgacatgcacatttgtgaagcgaaagtaaatgacattctatcagtgacctgaaaactcaaatgaattgtgacttgcctgtgaagaaatgaaaataaaaattgagggcaataagaatactaccctcaatattgatttttttc

SEQ ID NO: 28067 - DNA, 473 bp, Homo sapiens
gagtagctatagttgtatcaggtaaaatagactttaagaatggtaaaaacaacaaacaacaacgaagatgatcattatataatgacaaagagatgaattcagcaagaggatataccagttctaaatatatatgcatatgcgtcactggtgcacagagatatataaaggaaatattatttgacctaaagggtgagatagactccaacacaataatggttggggacctcaaccattgtcagcatcggacagatcatgtagacagaaaataaacattggattgaaactgcgctttagaccaaattggcctaacagacatttacagaacattttatctaacagctggagaatgcacattctttttatcagcacatgtaacattctccaggatagaccatgtgttaggccataaaacaagtctcaacaaaattttaaaaatagaaattatatcaagtatcttcttagaccacaaagga

SEQ ID NO: 28068 - DNA, 471 bp, Homo sapiens
  misc_feature 218: n = A,T,C or G
actacagaaatgagaatctctcaataaattagttcagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaanaatttatgatgactcagtggtgccagagtaaagtttctaaaataacattcctctcacttgtaccccactaaaagtattagtctacacattacattgaagttaaacacaaaattatcagtgttttagaaacatgagtccggactgtgtaagtaaaagtacaaacattatttccaccataaagtatgtatttgaaatcaaagttgtctctgtgtacagaatacatacttattcccatttttaagcatttgcttct

SEQ ID NO: 28069 - DNA, 358 bp, Homo sapiens
  misc_feature 13, 312, 338: n = A,T,C or G
agtttaaaatttngtaaaatgtaacaacgctccacagagaaattcttacgagtctcagttctttaaaataagggtcatacatgcaacccaaggaccaaatgtggttcactttaggcttttagctaaaacctgatttgtgagcacacatgaatactaatagagtctagctacctgtctgtagtaggaaatgaaaagagtctgaagtaaacagaaaaactgagttgagctgccacacagaaggggtttcttctgtgacaggagaggagtctcagtattttttttttgtttttacttcaaatgatatttttgggngttatccttttggaatcttgtggggnaagtttaatttttatgacac

SEQ ID NO: 28070 - DNA, 182 bp, Homo sapiens
aacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagcc

SEQ ID NO: 28071 - DNA, 472 bp, Homo sapiens
gggcaatgctgtgagagccattggaagactgtcctctatggcatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtggatgttttgcgggggatgacgatgccaagtacacctgcaaggctgtcaacagtcttggagaagccacctgcacagcagagctcattgtggaaacgatggaagaag

SEQ ID NO: 28072 - DNA, 228 bp, Homo sapiens
agcataaggaagaacagaacagaaagaagtatcctacagtggagagttccgtgccctggtggtatgcagcagagactgaatgatcactgtgagcaccagattaagacccagaccatgggttgtttaatgttctttaccatatttttgccctgggatcttaggattcttcaggcatggggatttttcagtagctattaagaattctgtgtttgggagacatcaagaagt

SEQ ID NO: 28073 - DNA, 142 bp, Homo sapiens
gggtatgtagagccatgttatggttatcaaagtggtttactgtaaggctgagggctatgcatcctatggctatgttgttgtctcttatttttccaaacgtggaaacctctgttttgtaacttgtagtaataaggtagaaaat

SEQ ID NO: 28074 - DNA, 469 bp, Homo sapiens
gtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttggagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagact

SEQ ID NO: 28075 - DNA, 390 bp, Homo sapiens
atatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 28076 - DNA, 473 bp, Homo sapiens
aactcgtgtaattctttcttgacaccaacaatactatacaaaccaaaaagatttcatttctatccatttctgatataagcattaacctaaggccacaatttctctagccattccagtgcctattctgtatgtggataaggtagattaacttgatttaatcactgtttaggtgaaaaagaaatccatctatggtgaatttttattaagtcagaattggaaaatatgttcttcacatttctcaaggtgatttaacagctcaaagtgtcttaaatccatatcaatagtctggcaagtacgataaacatcatagagttctaggacctagcttgaagaacttagctcctgtgtgacttttgctgagaatctgaaaatgaagacccagcggaatccttacctcaaagctaaaataaagtataaagaaaccaacactggaagataaccattttgcaaaagtacaaacctaactgatagag

SEQ ID NO: 28077 - DNA, 300 bp, Homo sapiens
  misc_feature 220, 245: n = A,T,C or G
gtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggttttttttttccttttatcgtctgatgatgaacttaatgtttccatttgtnttaatggaatactaagtccctctgngatttctgaaccaagctattcctaggcctgagttttattttgttgacacagaaat

SEQ ID NO: 28078 - DNA, 457 bp, Homo sapiens
  misc_feature 11, 27: n = A,T,C or G
gacataatagnagatagaaagcacagnaaggagcgtggatcggaagagaagggatacttcggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtggaggttccaaaatat

SEQ ID NO: 28079 - DNA, 130 bp, Homo sapiens
  misc_feature 124: n = A,T,C or G
atttccctctgaaaaatataacgacaaaagtgttcttgcctactaaggaaactcttgatgactatgctagcaagctgaataaacatttgaataaatgtttaacgagtcccactggcttaaaatntatttt

SEQ ID NO: 28080 - DNA, 340 bp, Homo sapiens
  misc_feature 7, 32: n = A,T,C or G
aaacttncttcaacaaaaaagtttggatgtanaagcagctgtaagaattcaactgtttattataacaagatactaaagagactgtaaaatgccacccttctccttggattgttttggaagttattcttcataaaaaatgttaacgtgggctgggcatggtggctcatgcctgtaatcccagcactctgggaggctgaggtgggcggatcacttgagctcaggaattcaaggtcagcctgggcaacatggctaaactctgtctctattaagaaaaaaaatgttaacattatgatttaaaagtgcattaaccttaatctagataataaaagctttttggggc

SEQ ID NO: 28081 - DNA, 416 bp, Homo sapiens
  misc_feature 7, 10, 21: n = A,T,C or G
aatagcnagnagacacttctncttacttaattctagttaagatctgtgatacgaaccatagatattgcctgacaaagcagaaatcaccaagtttcccccttttgaattaccaccaagaagtgttgaaacaccaaacagatatcatgttattttgggcatttgcagttttcttccctgctgcatgtaatgtctcagaatcaacattcttttaaaatctagactatattttgaggcaatgaattacttatattcaacttaggcttgttttgacattcagtagaactttaagttcaatctaaaggcttcagtccacatttttttatacgttgtattttaaaaacgtttgaaaggagtcttacacctgtatcatgaaaactgaatccttttgaaataccactatatgaagagagagatga

SEQ ID NO: 28082 - DNA, 119 bp, Homo sapiens
  misc_feature 17, 30: n = A,T,C or G
ggaacctggaagacagnaagtacgggaagncgaagaaaagaatagagaagatagggaaattagaagataaaaacatacttttagaagaaaaaagataaatttaaacctgaaaagtagga

SEQ ID NO: 28083 - DNA, 244 bp, Homo sapiens
  misc_feature 30: n = A,T,C or G
gggtcgttggctagaaggctgcccctcctntttctttctgcagaaggcagcgggaacagctgctgagagtagggcgatgggggattgggtaggagacatgagaggaatggaggaggtgtgatgtagctgctgtggagaatggaataatagaagtgacacatagaaagagcatgaggagatagtgagggctcagctgagattggagagtgagttaggcataaactcacttccctcccttttcatt

SEQ ID NO: 28084 - DNA, 396 bp, Homo sapiens
  misc_feature 31: n = A,T,C or G
atcttatttccacacaactaaaaattgacanagccagcacttgaaccgaaatgttctgactccaaatccaatgctctttctgctatactctgctttcatttcttgcagcaatacatctgccagtgaagaaagttcctgtctaccactgagctggtgaatatcacttaattaatttatttatttacttattcactaaaaaatatttgtttagcccctgttgtagttcaggtgttaaataggaccaatttggtgcctgcatgacatttgctctctgacagaggcaaaatacatgaaattaaaaagttatatcaagaattagttaaccacaatttgaataaattgttcaaaaccagaaatgtagaattcagcagtatatgaaaaaaggaagttaatttg

SEQ ID NO: 28085 - DNA, 473 bp, Homo sapiens
  misc_feature 6: n = A,T,C or G
tggcantcggaatactctattcccatctctttctctctctctcaaaatctttgtctcccactcccttcctcactccctcttcgctgcatctctttgtacatttgtggtggttttcctctgttgaaggatcagatctcctatttctctctctagtccattgtcattccagttttctggaactgggaatctgaaggtccagctttattctggtgtgtatctgtgattcaattcagcattgttaagaggttggagccagagtgatagtgagaccatttactagtctatgtctgctggggccgggtagtcagctggagcaggaggaagcctacagacctttgcggtgccagttgttaacctcctttaccttccaggtcatggagaggtcaggagactgacttgaggggcttgagggagcatctatcatcctgtaccactggtgtagccatactggttactgctgaatgtctatcctg

SEQ ID NO: 28086 - DNA, 470 bp, Homo sapiens
atttcacttcgtatatttaacattggataacagacagtagattcaaatattgttaacagtgctattgattgactgatactgtcctttacagcatttttgcttcagtataggatccactctaggatcacctattgcactcagttatcaagtgtttttttttcatttggaacatattctcaacctttctttgttttttatgacattacattttcggaacttgtaacttcttttaataagaataaaataatagttgacatccgtcaggcacttactaggagcttaagtacttgacagatactatttcagttaatcttcacaacacttctacaaggtggatactattattgtcccattttacaaatggcaagttctctgtttctagtcagtaaataatcaagaggagccgggatcaagaacccagtccacctagctccagaggcaatgttcttatggcttcagtgacatgtatt

SEQ ID NO: 28087 - DNA, 380 bp, Homo sapiens
  misc_feature 32: n = A,T,C or G
ggaagtctctttgcggcgctacactagagcanagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactat

SEQ ID NO: 28088 - DNA, 275 bp, Homo sapiens
gatggtggctcatgcctataatcccaacactttgggaggccaagatgggcggatcacttgaagtcaggagtttgagaccagcctggccaacatggtgaaactccatctctactaaaaatacaaaaattagctgggcgtggtagcgtgtgcctgtaatcccagctactcaggaggctgaggcaggagaatcgcttgaacccggaaggcggaggttgtggtgagccgagatcgcgccattgcactccagcctgggaaacgagcaaaactccctctcg

SEQ ID NO: 28089 - DNA, 466 bp, Homo sapiens
  misc_feature 5: n = A,T,C or G
agccncaccaagcctggaacttgctactctttttcctgcttcaaggcatttggagttcctgttcactctacctggatgcattttaactaatcctgaggacttcatccggtcaccatctacctattcttcaaatggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaac

SEQ ID NO: 28090 - DNA, 425 bp, Homo sapiens
  misc_feature 36: n = A,T,C or G
atcgcagtgatggcaatgctctgctggtttattttnagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattaggggg

SEQ ID NO: 28091 - DNA, 301 bp, Homo sapiens
  misc_feature 7, 298: n = A,T,C or G
gtgctcnaaaagataaacctataaaaatgaaaacaaaaccattataaaaatgccctttttccttgttaatgtttacctctagagacagaagatgtgatctttgggctagggctgttttctgatcaattggttcttctctttaggacccctctgggtcgagcaagagcgtggcttcgattagccctcatgcaaaaaaaaatggccgattacttacgttgcttaattattcagagggatctcttgaggttagtactattaagtcgtgatcttttcattttttattttatttatatgctgnctt

SEQ ID NO: 28092 - DNA, 410 bp, Homo sapiens
atggttctgtttttctgtgtgtcagttttcttagtatccatattttattactgtttattacttccatgaattttaaaatctgagggaaatgttttgtaaacatttattttttttaaggaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaaga

SEQ ID NO: 28093 - DNA, 479 bp, Homo sapiens
  misc_feature 9, 31: n = A,T,C or G
cagaaccanattggggggtctatattcagcnttcttaaagaaaagaaattccaaccaagaatttcatatttggcaaaactaagcttcataagagaaggagaaataagatccttttaagacaagcaaatgctaagagtatttgttaccaccagacttgctttacaagatgtcttgaagggagtgctagatatagaaaggaaagactgtgttaccaaccatcacaaaaacacatttaagaacgtagactagtaatgctataaagcagcaacacaatcaagtctgtgtgataaccagctaacaacgtgatgatgaaatcagacctgcatataccaatattaaccttgaatgcaaacaggctgaaagccctaattaaaaggcacagaatgacagcttggataaagaagcaagatcgaactgtatcctctctacaggactcatctcacatgcaatgacactcataggctataagtaaagggatg

SEQ ID NO: 28094 - DNA, 134 bp, Homo sapiens
  misc_feature 24, 50: n = A,T,C or G
gctctactctttttatgttattgntgtgacaaattatatctttattcatngtataccagctaacagatttacaattacattttatgcatttgccttttaaattatgtagaaaataaaaagcagagttacaaatc

SEQ ID NO: 28095 - DNA, 267 bp, Homo sapiens
  misc_feature 16, 28: n = A,T,C or G
caggctcaaaaccganaccggctgtganatccacacatctttagaactagtcgtctcctcttggcctcagcagctcttccctgttcttactggttggcattttgatcactctttgcacactcttgtgttttttgctcactgtcacattcccagcacctagtatgctcagtaaatgtttgtggaataagtgcataaaatgttcttaacctttgattctacttacagcccatgatagcctcttagatataataaatttggattatacta

SEQ ID NO: 28096 - DNA, 465 bp, Homo sapiens
  misc_feature 6, 31, 32: n = A,T,C or G
caagtnctcagcagggttggtttcttaggcnntccttggcttgtagatggccaccttgttgctgtgtcctcacgtggcctttcctttatatgtgcgtgcccctgccacctctatcttaagaggacaccagtcatattggattagggtcccaccccaacaacttcatgttaacatcatctctttaaagaccctgcctccagctgggcacggaagctcacgtctataatcccaccactttgggaggctgaggtgggcagatcacctgaggtcacaagttcgagaccagactggccaacatagtgaaaccctgtctctactaaaaatatgggcacggtggtgggcacctgtaatccagctactcaggaggctgggacaggaaaatcgcttgaacccaggaggcggaggttgcagtgagctgagatagctccactgcactcaagcctgggtgacagcaagactttctca

SEQ ID NO: 28097 - DNA, 409 bp, Homo sapiens
  misc_feature 7, 32, 55: n = A,T,C or G
gaaggcnttgaggcagccagcgcaggggcttntgctgagggggcaggcggagctngaggaaaccgcagataagtttttttctctttgaaagatagagattaatacaactacttaaaaaatatagtcaataggttattaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttt

SEQ ID NO: 28098 - DNA, 281 bp, Homo sapiens
  misc_feature 51: n = A,T,C or G
agaaaaggatgctttgctttgggttgtagtcaaaaactgattaaataattnaatgtctctggcacacactaaaaaccatacacttcagttgtgatctcagtggcatatttatttggttaggtttcgttacatttattattacagatgttcagttgaccaagtagttcagtgttttctttcctttttttggaaattttagtttgagtttgtgactgcagtgttcaagaactcagcatccttgttttctacaaatactgattaaaataaaatgctgtaaaatg

SEQ ID NO: 28099 - DNA, 285 bp, Homo sapiens
  misc_feature 2, 7, 26, 29, 36, 55, 96, 97, 120, 158, 163: n = A,T,C or G
anaaccnttgtgaatacttggaaccnacnttttgtncattaatgatagactggantaagaaaatgtggcacactgtacaccatggaatattatgcnnccataaaaacgatgaattcatgncctttgcagggacatggatgaagctggaaaccatcatnctcancgaactatcacaaggacagaaaaccaaacactgccatgttctcacccataggtgggaatcaaacaatgagaacacatggacacagggtggggaacatcacacaccggtgcctgtcagggagt

SEQ ID NO: 28100 - DNA, 489 bp, Homo sapiens
  misc_feature 7, 32, 33: n = A,T,C or G
ggtaggngcctctctccctactgctgctacannagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctg

SEQ ID NO: 28101 - DNA, 284 bp, Homo sapiens
  misc_feature 26: n = A,T,C or G
aatgtttaaaaatatgttgacatggnagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcatt

SEQ ID NO: 28102 - DNA, 438 bp, Homo sapiens
  misc_feature 25: n = A,T,C or G
gaatgttgctggtgtctctctgacnactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattcta

SEQ ID NO: 28103 - DNA, 377 bp, Homo sapiens
  misc_feature 5, 6, 28, 29, 30, 32, 150: n = A,T,C or G
acagnngaaacccatctctactaaaatnnntnaaatcagccggacgtggtggcgcacacctgtaatcctggctactcagtaggctgaggcaggagaaccagctgaacccaggaggtagaggttgcagtgagctgagattgtgccactgcnctccagcctggggaacagagcgagattctgtctcaaaaataaaaataaaaataaatttaaaaaagagtgaggaatgagctagaagagacatcatggcaggaagatgggggacagattccttcggtcctaagggactagggtgctgggttgaatgaacatttttccagaggttctacagtaaatataaagaaattagagctatacccaaataaatatattatttgccg

SEQ ID NO: 28104 - DNA, 415 bp, Homo sapiens
ctgctgaaccctcaaatgcagatgactgctaccagtccaagctgaaggggaaactgatgcccaatctttatcctccagaaaccatagcagatggtgtcaaatccagcattggcttgaacacctggcctattatcagggaccttgtggatgatatcttcactgtcacagaggatgaaattaagtgtgcaacccagctggtgtgggagaggatgaaactactcattgaacctacagctggtgttggagtggctgctgtgctgtctcaacattttcaaactgtttccccagaagtaaagaacatttgtattgtgctcagtggtggaaatgtagacttaacctcctccataacttgggtgaagcaggctgaaaggccagcttcttatcagtctgtttctgtttaatttacagaaaagga

SEQ ID NO: 28105 - DNA, 379 bp, Homo sapiens
ggtaatggtgatttaatgttcgatgtgtacagaatttgtttgaaatgatgaaaaagttctagaaatgatgatggttgcacagtgttgtgaatgtacttaatgccattaaattgtacactcataaatggttaatattgtaaatttcatgttttatcataaaaaatattttaataaagcctgtctcctggctccccattctcccctccctcctagtattgggtctttgactttcttgttaaggttaatcctaactgtactataatttttgtactattctgaacatttttttaaattataaggctaatttttatatcaaaattttaattcagcacttaccaaggtttttaaaaaaattaattctagacctttaaaaatttga

SEQ ID NO: 28106 - DNA, 228 bp, Homo sapiens
ctggcacacacctgtagctctagctactcgaggagatgaggtagaaggatcacttgagcccaggagttggagccacagtgagctatgatcacaccactgcactccagcctaggtaacaagagtgaaatcctgtctcaaaagaaaaaggagaaggagaaggaaaaagaaaagaacaagaagatgaggaagaggaggagaaagaagagcaacaagaattggagaatagac

SEQ ID NO: 28107 - DNA, 342 bp, Homo sapiens
agagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacaactctttggacactaggaaaaaaccttgtagagagagtaaaaaatttaacacccatggtaggcctaaaagcagccaccaattaagaaagcgttcaagctcaacacccactaccg

SEQ ID NO: 28108 - DNA, 497 bp, Homo sapiens
agagctcacaacatgatttttaggtttatcaaaaaatgtcatgaatgtttctatatttcttgttggtttatttctcattattgagttatatattgctggaagtttaacaacttctcttgaattccaacaggaagcatttgctaggtaggcatttggtacctaatggataatctttcatgatggataaatctgccacatcagtctctcttgactttgaaaattaaaatctgggcactttgggaatttctgctgtcttaattggctggcctgtcctgtgaacagccgtcttctctaaatggtataataactgcatttcagcgctgtctcattgtgagtctttttgaaagcttttaaaatgatgttgtgtgatccaaatttaaattaatagttaagcagtgtgttctaccaccaatgcaaataactcaactgaatgacaattggatcctgcttcactcagtttgcgcataaatggttgaggaaaactacatcataggtga

SEQ ID NO: 28109 - DNA, 172 bp, Homo sapiens
ctgtcactaactcctaaaacatttaggccaggcacagtggcacacgcctgtaatcccagcactttgggaggctgaggcaggagaatggtatgaacccgggaggcggagtttgtagtgagtggagatcacgccactgcactccagcctgggcaggagagcaagactcggtcac

SEQ ID NO: 28110 - DNA, 412 bp, Homo sapiens
  misc_feature 2: n = A,T,C or G
gncccggaggtggcaagaaggatgacaaggacaagaaaaagaaatatgaacctcctgtaccaactagagtggggaaaaagaagaagaaaacaaagggaccaggatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctg

SEQ ID NO: 28111 - DNA, 498 bp, Homo sapiens
aggctgtgtcagtgaatgcttctgtccaactaactttccatcatcaatgtactgtgataatcgcaaactcaagactatcccaaatattccgatgcacattcagcaactctaccttcagttcaatgaaattgaggctgtgactgcaaattcattcatcaatgcaactcatcttaaagaaattaacctcagccacaacaaaattaaatctcaaaagattgattatggtgtgtttgctaagcttccaaatctactacaacttcatctagagcataataatttagaagaatttccatttcctcttcctaaatctctggaaagactccttcttggttacaatgaaatctccaaactgcagacaaatgctatggatgggctagtaaacttgaccatgcttgatctctgttataattatcttcatgattctctgctaaaagacaaaatctttgccaaaatggaaaaactaatgcagctcaacctctgcaataacagattagaatc

SEQ ID NO: 28112 - DNA, 166 bp, Homo sapiens
accagtggtttgtgcctaataacttattacaaattattacccagtaaaaaccttgagacaagagtgaaaacgtaaagctaattaatccattacttgttagcaagcaaactacgtgcttgagaaaattactcaactttcatgttttacttccagacagtagtttgat

SEQ ID NO: 28113 - DNA, 209 bp, Homo sapiens
aaggacgactgaaataattccaaaggagtgatgttggaatagtccctctaagggagagaaatgcatttgaacgaatgtgatataaaaccacataatcaaatagaaacttcatgtacttacaaaaactgagtttgtaaaattaccttcatttctttgacattaaatgcttatattagcaataaacatgttgacactttcctataaaaaat

SEQ ID NO: 28114 - DNA, 490 bp, Homo sapiens
  misc_feature 8, 20, 32, 33, 35: n = A,T,C or G
gaagggcnacatctacaagncccaacaacaanntncatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttc

SEQ ID NO: 28115 - DNA, 473 bp, Homo sapiens
  misc_feature 25, 78, 150, 261, 293, 418, 460: n = A,T,C or G
tctacatagcagaaattgatttttnttttatttttttaggggaacctatataattatgacccagtgatgtcttttggngacttaagcttatgaattcaggttacaattgagttgattctagatggttactaccttgaaaaggatgttggngccttatgtgacacgagccagagcctgctgggaataaacaaagcagattcatgccaacaccaactcgtagctttagtggcagatgggagtggtcacagactcccaaaatgnggggctttggatttccacaccatcccacgtgngtgtcatcttcctctttcacactcttgatgataatttgaaaatggggaaatcacctctgaatttgcctatagcatgagcacattcttatgacaacataacaaatagttcataatgtgaatattanaaactgttacagcctgcagttaccataattttccatgtttgnggaattgatattg

SEQ ID NO: 28116 - DNA, 387 bp, Homo sapiens
  misc_feature 22, 24: n = A,T,C or G
aaaatttttattgtttcttttncncttattatcaaggtgagacatgcttagtgtaaaacgtttttttaaaactatggaatagcacacaaaataaaaaataaggtgtaatcccaccacctacacgtagtcactgccaacattaaagagtatgtaaccttccctctccttcccatgcatatataagcttttgtataggttataaaattaagatcaaaatgtacataagtctttgtaaactgcttttaaaatgtaaggctgtattggaaacatttttccatggtactaagtacatgtttatgacctgatttttttagtggctccacagcatggatgcaccataatttatttaaccaattccctgtttattgggtatttgattttcttctg

SEQ ID NO: 28117 - DNA, 396 bp, Homo sapiens
  misc_feature 386: n = A,T,C or G
tcttcagcctcctcattcatcaaattagaaggttgaaccaagtaagaatttctgcctctttctatgtctagcacttaaaattattatccagagagtggctggttgtcatttattctccagattcacctagatgagaaccattatgaaggaggctgaaattgcagcaaggagtgcacaggttgaatttgaataactttaccataaagagaaatattgactgcaggactggattatgctgttaatctgactgctcttaggagtccttaaaaataaatcaataatatacatggcctgcctttatagatattttttgcatatagacctacctgtggctagcatcaattaaaaagaaggacagactctcctagaaacaggggccaattcgncctatagtga

SEQ ID NO: 28118 - DNA, 276 bp, Homo sapiens
cgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcac

SEQ ID NO: 28119 - DNA, 355 bp, Homo sapiens
  misc_feature 25: n = A,T,C or G
aagaagaatcctttgggttttacanaatggtgaccttatcaggtgctgtttcagtggaatcttgaattcaggagccactcaagaatgaatgagaactgatggagtaaacacagcatgcgtagataagtcaagaaccttggctgttaaaaaggagtaagaaatatggaatgatccaatagagagggaaagaaggtgatgcaggggcagaggccacatggacaagcgcagacagcacgtggcaaaggcctctatgccattacccatggaagaaaactgaagaggtttaagcagagaactatttgattggactgtttcattgggtaaattattctgtcattgtgggagatgaatttgg

SEQ ID NO: 28120 - DNA, 490 bp, Homo sapiens
gtaaatcgagaaaacaaaaaaatatatactactggagcattcatgtatagttggagatcatgactcatttattggtgtgtttttggactcagaacaaagatgagggaatattccttaaagctctgtattgaaataacgaaaagcagtcacattttaataatagaagcttcctagcttactctttctgtaatcttcttttcctaaatgtaagagagcctcataattatgaggcttattactagagtaaggctgtcaaaggcagcaaaatgtctttctgtttggaagaataacataaacttgacatgtatggtgggggacagaaggtttcaaaagtttaagaatctgtgttgtcttaacaaatagatgcttctcaaggagcttacgctagtggttactctgtccagtcagggttttttcttctttaacttgggttcatttcctgatggcacacatgaagtttggatcatatggtttgactttagctatggtc

SEQ ID NO: 28121 - DNA, 490 bp, Homo sapiens
  misc_feature 3, 4, 31, 34: n = A,T,C or G
aanntgccacctggacaatgacaagtacatnttnctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcat

SEQ ID NO: 28122 - DNA, 419 bp, Homo sapiens
tgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattat

SEQ ID NO: 28123 - DNA, 104 bp, Homo sapiens
ctgtaagtcttgcttaatttattgaaaataaagctacatttttcagtgatgaacatttcttgatgacagtaatgatgatgcatgaattaaatgaggagatagga

SEQ ID NO: 28124 - DNA, 164 bp, Homo sapiens
  misc_feature 24: n = A,T,C or G
aaaaccttcagaaggaaaggagantgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 28125 - DNA, 112 bp, Homo sapiens
aaagagtccactctgcacttggtcctgcgcttgagggggggtgtctaagtttccccttttaaggtttcaacaaatttcattgcactttcctttcaataaagttgttgcattc

SEQ ID NO: 28126 - DNA, 224 bp, Homo sapiens
attttattttttcttatatcagtcttgcagcattcactgtagtgatagaaaacaagttaggaacatagccaattaggacaaggaggatttaaatgtgtcttacctttattttgtaaaataggtataaaggagtaattaaaatgaatttttgaaatttgggtcttttacaagctgatgattgttgcattttggagttgcaacaacattaaaacagtttcaatggt

SEQ ID NO: 28127 - DNA, 176 bp, Homo sapiens
  misc_feature 6, 7: n = A,T,C or G
atttgnngaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctccc

SEQ ID NO: 28128 - DNA, 403 bp, Homo sapiens
  misc_feature 2, 18: n = A,T,C or G
gntcactgaagcttaagngaggacctccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcaga

SEQ ID NO: 28129 - DNA, 309 bp, Homo sapiens
gattacccggttaccctattgaataggtcagatgtagaatcttttcatcatcacagaaagttctattggacagtgctcttctagatcatcataagactacagagcacttttcaaagctcatgcttgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaagc

SEQ ID NO: 28130 - DNA, 495 bp, Homo sapiens
aattttttttctagagacgaggtctcattgtgttttccaggctagtcttgaactcctggcctcaagtgatctcccacctaaccatctcaagtagctgcaattacagatgtaagacaaggcacctagccttcagcagtttttgttttcttttgttttttaaaatatctccaaaagaggccacagtgatttagctttaccctggccacattaacacagattgctgttcacttcagtggtgccaacacttttaaatatgatatcatttcatagagaattaagcagcattttgtcacaagacctagaatgttaaaagaacaggaaagataggaagtgtgaggagcaaccaagaagaaattatctttcagcctgtagagtcttgagtttagagacaatcaaacaaaagaaaccagttaacaattcaactttttctataaaagataaaaacagatcaagatttcttttctaatttgcttgtgatttggaagctagaagttg

SEQ ID NO: 28131 - DNA, 210 bp, Homo sapiens
  misc_feature 25: n = A,T,C or G
gctgggcatctactttaaaacaaanttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgc

SEQ ID NO: 28132 - DNA, 327 bp, Homo sapiens
  misc_feature 24: n = A,T,C or G
gatagcatcttatacgagtaatangcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgcgtgtgtgtgtgtgtgtgtatatatatatat

SEQ ID NO: 28133 - DNA, 222 bp, Homo sapiens
  misc_feature 19, 24: n = A,T,C or G
gcaaacaattactgtcgtnggganttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacctttcttcccctttacagcacaaataaagtttgagttctaaactc

SEQ ID NO: 28134 - DNA, 129 bp, Homo sapiens
gtcgatgaagaacgcagctagctgcgagaattaatgtgaattgcaggacacattgatcatcgacacttcgaacgcacttgcggccccgggttcctcccggggctacgcctgtctaagcgtcgcttgctg

SEQ ID NO: 28135 - DNA, 239 bp, Homo sapiens
ctggacaaagctcctttccgaatattgagctcatcagtgagaaaacggctgcatattggtgtcaaagtgtcactgagctaaaggctgactttccagacaacgtaagtgtgatttaacatctaaaacaagagaattggcataagttggtgaatgtttatttaaacatccaattcataggcttataaatattaatgtgtatattttattaaagaatctgccagttgctttgctgatgcatg

SEQ ID NO: 28136 - DNA, 495 bp, Homo sapiens
  misc_feature 22: n = A,T,C or G
tcattgtcatctttgtgtttanctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctagactcctttggttagagaagccacagtccttcagcctccaattggtgtcagtacttaggaagaccacagctagatggacaaacagcattgggaggccttagccctgctcctctctattccatcctgtagaggtcaggagtcaggagtcgctggcaggagacagcatgtcacccaggactctgccggtgcagaatatgaacaatgccatgttcttgcagaaaacgcttagcctgagtttcataggaggtaatcaccagacaactgcagagtgtggaacactgagcgggacagctgacctgtctccttcacat

SEQ ID NO: 28137 - DNA, 195 bp, Homo sapiens
  misc_feature 194, 195: n = A,T,C or G
gatcaaattttcaaaagttaatgacgaagaatttgaaagcagcagaggaaagcaacttgtcatgtacaagggagctcctataagactttcagcaggtttttcagcaaaccttgcaagccagaagagaatgggatgatatactcaaaatactgaaagaaaagaaaagcctcccaactaagaataatttacccgcnn

SEQ ID NO: 28138 - DNA, 414 bp, Homo sapiens
atccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtatctctggaaccccttttggcttaggtttatgggctgtgagttggttggaataaggggaatgattgggctcttggattctcaacctcaggttgatagagaagaagagagaaagatgtcacagatgacagaggccgcctgtataaccaaagcacatattttctccatcttagccttgttctttactgacacattagtgtccctccactttccctttctct

SEQ ID NO: 28139 - DNA, 250 bp, Homo sapiens
  misc_feature 3, 8, 33, 65: n = A,T,C or G
aancaacntaaaattttcatgtcaaacttcttntccgaaagctgctaaatacgtgtctggcaggnaaaagctggaaaattacttaaaacaggaaagtgtcaataaaaaaacttgagcaacaccaacatattttttcttaaaatgtcacgttatcttcattttgggaaactaggttctataaaatatttatcctccctgttatactttggagcacagcacagccagaaaggggctgcatttgtgcccaggt

SEQ ID NO: 28140 - DNA, 425 bp, Homo sapiens
acacaaacaagggccttttaaatgaatgcatctatttagttgctttctgatcagctgttgtctttcagattgtatgattataggcaaagcaaccattgaaagatttgtagatttgggaaattttgtaagtagtgtagttgtagcactgttccttcacaggagaaagtttccacccggtaggcagaagtcttaaccagtagttagtattaactgatggaaacagggtcaagagtccaaactggcactgaatctgagattgctgaattaccctgagagggcaaaggcttcatatgtagacctaaatgaagataacagaatgagtcaccagtatagacaatgctggtcttttccagtttcgtgactgcacagcttagactttgggggacatttggtttacatcactgggaataaaacttagagacaga

SEQ ID NO: 28141 - DNA, 109 bp, Homo sapiens
  misc_feature 4, 66, 73: n = A,T,C or G
tcanaatgtcaaatctttcttttggttgtgctgcacctgactttcatccttaaggtcctgcacggntcaaggnggctgctggagctccagccattacccctgcattgag

SEQ ID NO: 28142 - DNA, 107 bp, Homo sapiens
accttgaggtcttttgacatgtggaaagtgaatttgaatgaaaaatttaagcattgtttgcttattgttccaagacattgtcaataaaagcatttaagttgaatgcg

SEQ ID NO: 28143 - DNA, 309 bp, Homo sapiens
  misc_feature 6: n = A,T,C or G
caaatntggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaact

SEQ ID NO: 28144 - DNA, 405 bp, Homo sapiens
  misc_feature 6: n = A,T,C or G
aagagnatgttaaatactatgcttttttgttagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcattttaagcaaaattttaagaaagttttgaaattcat

SEQ ID NO: 28145 - DNA, 405 bp, Homo sapiens
attcaccagcctttactaagcacatgcagtgttcttggtacctagctaggtgctgttgttacaaagataacaacaaatctggaaacgagacaagcctctgagctcatgaatttcagtgttatgtgctaagcactcggttatagctatgaacaaagtgtcttgaagcctggaggaagaagcaactccctctccagggtgctagagatggcttcccagattagatgacacttgaactgagagatgaagtatttaccaggcagagagaggtggagaaaggatttaaggtagaaagaacaacatgtacaaatggaaagagttgcaaaagtgcaatgaggtttgtagagatatgttgggttgcaattgggagggacttcatgtgccagatttaggcatttggatttttat

SEQ ID NO: 28146 - DNA, 368 bp, Homo sapiens
  misc_feature 8: n = A,T,C or G
gaaagcanttctggttttcaaaacaggaagccttagttggagatattacagtcaactttggcttctaagccagtaattccattcttaaatacctcactgtcttggccatggggaagcactatggcctcagctgggggaaagaccctggcctaggggtcttagccactccccaccctagggtatagttcaggggtatccaatcctttggcttccctgggccatgttggaagaattgtcttgggccacacataaaatacagtaaccatagctgatgagctaaaacaaaaaacaatggtttgtgcaaaaatctcataatgttttaataaagttgaagaatttgtgtttgggcctcattcaaagccatcctg

SEQ ID NO: 28147 - DNA, 123 bp, Homo sapiens
  misc_feature 23: n = A,T,C or G
taaatgtagagagactgatgggnaaagtatgatgggtttgatttttatatcaaatcatcaggcatggagaaatatcttttagaagtgttaaaataaatgttcctactgtatatttaaaatacc

SEQ ID NO: 28148 - DNA, 383 bp, Homo sapiens
  misc_feature 7, 32: n = A,T,C or G
ggcatcntaagaagcatcctctgccaagtacntaaaggaaagaagaaaaagggccaaaagccaaaatgaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggaga

SEQ ID NO: 28149 - DNA, 339 bp, Homo sapiens
  misc_feature 7: n = A,T,C or G
agttagnaaacagaagattcaacatttcttgtttattaaataaatttctaggttttatggggaaaggagaaatgttacaaagctacttaactttccctggttgaaaagatcacataaagtaatatataaaaatgcatggaataatacaaaattatatacaaatgcaaggtgatattataattatggcttattagaaatatacttagcagtatttctctttgattttcccaaaatcaagtatacccacactgctgttctcatcccttaacagacataatcacaaaattatatcataatataaatgtaagtccatttcagtaaactgttttcaagtcatac

SEQ ID NO: 28150 - DNA, 462 bp, Homo sapiens
  misc_feature 8: n = A,T,C or G
aagaaagncctcttgtccggctccttctgcttgttctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacct

SEQ ID NO: 28151 - DNA, 150 bp, Homo sapiens
ggcggccagtaactatgactctcttaaggttccaaatgcctcgtcatctaattagtgacgcgcatgaatggatgaacgagattcccactgtccctacctactatccagcgaaaccacagccaagggaacgggcttggcggaatcagcgga

SEQ ID NO: 28152 - DNA, 119 bp, Homo sapiens
  misc_feature 30: n = A,T,C or G
aaggactgcagtatgcttaatggtagcaantgaaagaagacatcctgagcagtgccagctttcttctgttgatgccgttccctgaacataggaaaatagaaacttgcttatcaaaacca

SEQ ID NO: 28153 - DNA, 159 bp, Homo sapiens
  misc_feature 28: n = A,T,C or G
gaagcaaggcctcaggatataatagccnacttctgattattcagaagtgatcagcccgtttggaggattactcaggcctcttgcttccttccctcctttggcagtgcctgctgctgtaaagcatattattactcatcagcacctccatcaaaatgtcta

SEQ ID NO: 28154 - DNA, 214 bp, Homo sapiens
tcgggccgatcgcacgccccccgtggcggcgacgacccattcgaacgtctgccctatcaactctcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgaca

SEQ ID NO: 28155 - DNA, 484 bp, Homo sapiens
  misc_feature 6, 30: n = A,T,C or G
gatgcnattgtgcaaggtgatattcttgtnctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttga

SEQ ID NO: 28156 - DNA, 477 bp, Homo sapiens
  misc_feature 7, 30, 32, 33: n = A,T,C or G
aaggtcncgccattgcacttcaacatgggntnnagagcgagactccatctcaaaaaactaaataaataaaaataataaaaagcaccctattcaaaagtcagtgaaggccaggcgcagtggctcatgcctgtaatcctagctctttgggaggccaaggcaggcggattgcctgagctcaggagttcaagaccagcctgggcaacacagtgaaaccccgtctctactaaaatacaaaacattagccatgtgtggcagcacgtgcctgtagtcccagctactcgggaggctaaggcaggagaattgcttgaacccaagaggtggaggttgcagtgagatgagatcgccccactgcactccagcctagtgacagagtgagactcagtctccaaaaaaagtcaatgaaaggctgaggcggaggatcactttgagcccagaagtttgagaccagcctgggcaatgtagcaagaccctgtctct

SEQ ID NO: 28157 - DNA, 159 bp, Homo sapiens
  misc_feature 159: n = A,T,C or G
taactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacgtn

SEQ ID NO: 28158 - DNA, 128 bp, Homo sapiens
  misc_feature 10, 15, 34: n = A,T,C or G
cggggaaaantaacnagccttggctatttaaaanttgtaatttttttaatttacaaaaatataaaatatgaagacataaacccagttgccatctgcgtgacaataaaacattaatgctaacacttttt

SEQ ID NO: 28159 - DNA, 412 bp, Homo sapiens
  misc_feature 4, 12, 34: n = A,T,C or G
agcnaccaaagnaagaagatccgcacgtcacttnaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatat

SEQ ID NO: 28160 - DNA, 183 bp, Homo sapiens
  misc_feature 6, 33: n = A,T,C or G
ggtgancctccgtctctactaaaaatacaaatnaattagctgagtgtggttggcacgtgcctgtaatcccagctacttgagaggctgaggcaggagaatcgcttgaacccgggaggcagaggttgcagtgagctgagatcgtgccactgcactccagcctggtgacagagcaagactctgtct

SEQ ID NO: 28161 - DNA, 114 bp, Homo sapiens
aaagttaattgcttgtcaagctataaccacaaaaataatgaattgatgagaaatacaatgaagaggcaatgtccatctcaaaatactgcttttacaaaagcagaataaaagcga

SEQ ID NO: 28162 - DNA, 352 bp, Homo sapiens
  misc_feature 25: n = A,T,C or G
aggtatttccaatccccgtcgaggncaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatg

SEQ ID NO: 28163 - DNA, 408 bp, Homo sapiens
  misc_feature 25: n = A,T,C or G
gtctgccattttcaattttcagagnctattgactgtaatcttgctgcttatatgtacctgtgcttatattcgatccttggcacccagcctcctggacagaaataaagctggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccattta

SEQ ID NO: 28164 - DNA, 207 bp, Homo sapiens
  misc_feature 19, 132, 151, 203, 206: n = A,T,C or G
gtatttggaaacgcggagngagtttttccgtgctgtgtaggggctaacaatggacacccagaaggacgttcaacctccaaagcagcaaccaatgatatatatctgtggagagtgtcacacagaaaatgaaanaaaaattctagggatccantcagatgcagagaatgtggatacagaataatgtacaagaaaaggactaaaanatng

SEQ ID NO: 28165 - DNA, 318 bp, Homo sapiens
aaggtggcaagaagaagccactgaaccagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgtctgaggagatggtgaccctttatttcatctgtatttaaacctctctattccctgccataacatcttttgccacgtatagctggaattaagtgttgtcttggagctgttgtacatttaagatt

SEQ ID NO: 28166 - DNA, 428 bp, Homo sapiens
  misc_feature 7, 30, 32: n = A,T,C or G
agctgcngtagatacgaatccaatccagtntnaacaggaagagaaaaacatccaagcactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtctattaccaacttctcacttagattaacatcaatgatgtttgattattctggttaaccgctcacatgcataacaataatgctagaaattcaggaattataattttgtgatttatactgtgtg

SEQ ID NO: 28167 - DNA, 388 bp, Homo sapiens
  misc_feature 7: n = A,T,C or G
tactgcnttcgtgcttttgcagatgctatgttggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttg

SEQ ID NO: 28168 - DNA, 352 bp, Homo sapiens
  misc_feature 32, 34, 352: n = A,T,C or G
aagaactccttcaagtatctaactcatttccnancatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacan

SEQ ID NO: 28169 - DNA, 393 bp, Homo sapiens
  misc_feature 23: n = A,T,C or G
tcgttgctggcctggctgtcctngttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcgtctgaacgtgtctgcgttcctgttagcataatgtgaggaggtggagagacagcccacccccgtgtccaccgtgacccctgtccccacactgacctgtgttccctccccgatcatctttcctgttccagaga

SEQ ID NO: 28170 - DNA, 145 bp, Homo sapiens
aaccagcccagactggagcagttcagaaaactccaagggcaattaaaagaaaaaattgtgatagaattcctaatttacttaaacatattgaaaggagatttacacaaccagaggagggtttgatgtgaattagtgatgcattcac

SEQ ID NO: 28171 - DNA, 174 bp, Homo sapiens
gtaaagttgcctggaatgtcctttgttaggttataaacacaagatctaaatgaagggttttatgtgttgtgtacaaatcttattttgaaatggacaaacctgtcattacatttgtaaccttgtacagaggatttttcactatgtgcctagcttggtgtccattcagctaaaatt

SEQ ID NO: 28172 - DNA, 465 bp, Homo sapiens
  misc_feature 26, 27: n = A,T,C or G
aaaaaatgcccaaaactcttcaggcnnctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcat

SEQ ID NO: 28173 - DNA, 130 bp, Homo sapiens
  misc_feature 24: n = A,T,C or G
gtggttgcatccctgtagtcccanctattcaagaggtcgagatgggagtatcacttgaggccaggaatttaaggttgcagtgagctgtccactgctttctagactgggcaacagagcaaaatgctgtccc

SEQ ID NO: 28174 - DNA, 309 bp, Homo sapiens
aacacgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttg

SEQ ID NO: 28175 - DNA, 154 bp, Homo sapiens
  misc_feature 48, 55, 65, 67, 104: n = A,T,C or G
agtctacttttacaacgctttcccctcattcttgatgtggtgtaatcngaagggngtggaatgcntngtcaatcatttgtcacatttatccagtttgggttatnctcattatgacacctattgcaaattagcatcccatggcaaatatattttg

SEQ ID NO: 28176 - DNA, 460 bp, Homo sapiens
  misc_feature 6, 31, 32: n = A,T,C or G
ggcgcnctagatatagtaccgcaagggaaanntgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 28177 - DNA, 353 bp, Homo sapiens
tgaccagtggttctcaagcatcagccttacatcaaaatcacagagagtagacgtggcatgcgaggcggggtgggagacagttgttaaatcactgattactgggacccacccctagggtttctgactccgagggtctggagtggtgactgagaatttgcatttcaccaaactcccaggtgatgctgatgttccaatctaagaccacacctccagaaacactctattccagttccgctcagatattaatgtgcaaataactcacctgaaaatctttttaaaatgcagattctaatttagtgaagttcctgggaaatgaagcaaattgcattactttctcttttttttgttttttg

SEQ ID NO: 28178 - DNA, 105 bp, Homo sapiens
  misc_feature 24: n = A,T,C or G
tgcagaattgtttagattttgtgnttattcttgatgaaaagctttgtttgttcttgtttttaagtttgcactcaaatcttaagaaataaatccacccatgttatc

SEQ ID NO: 28179 - DNA, 461 bp, Homo sapiens
cacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctgggga

SEQ ID NO: 28180 - DNA, 347 bp, Homo sapiens
  misc_feature 24, 25: n = A,T,C or G
taaattttaatttcacttgaggcnnttaaatatctaactcaaatgaacaaaatgtttaaaaagtttgtgagtaattatactctaaagttaaatgtagaagtttctgtccaataagctgttgttccccatatgtggcagatattggagacttaaccagcattcttgaggaataagatgttctagtcattctgttttttaaattagctgagggctcaccagtgaatcaatgaatatatttgatctgagttgtttttgttgaaaatacttctaaaataggtagtattcctgagttaaccaagtatactgaatataggtgaatattttgatgttaatttgttaatatttga

SEQ ID NO: 28181 - DNA, 250 bp, Homo sapiens
catgtcctataaacacaattattcactagtattctttcaattctgcctttattacatgatgatctgctaattcagaatgagaaatttccacattaagtacttggcaggactgggtgtggtggctcatgcctataatcccagctacttggggggctgacacaggagaatcgcttgggcctgggaggctgaggttgcagtgagctgagatggagccattgcactccggcctgggcaaaaagcgaaattccgt

SEQ ID NO: 28182 - DNA, 167 bp, Homo sapiens
aagtagttggtttgtatgagatggctaaaaaggccaaagataaaaggtttctttttttttccttttttgtctatgaagttgctgtttattttttttggcctgtttgatgtatgtgtgaaacaatgttgtccaacaataaacaggaattttattttgctgagttgtcc

SEQ ID NO: 28183 - DNA, 356 bp, Homo sapiens
ggcctactttacgttacttactctgtaccttcaagcaggcacataaaggctcagtctgtttcagctctgtgcactgctgagcagtgtcttaccatgactgacctcctgattaagaggaagttagcacgtgagagccacattgagtctgctggccttagcttcatgtgctatgtgagagatgtggtcattttgtacacaggatgttataatgggatattgacattttacggatccagcatcctgtgtataaattaagctttctttttaagaagacattttacagttgtaaaattctcgcctatttgaattttgagatcttgatgaaacataatccctggagtgctcttccactgttg

SEQ ID NO: 28184 - DNA, 220 bp, Homo sapiens
  misc_feature 3, 25, 47, 55, 70, 89, 95, 123, 139, 214, 216: n = A,T,C or G
gtngatgaagaacgcagctagactncgagaattaatgtgaattgcangacacatnggtacatcgacactnagaacgcacttgcggcccngggttnctcccggggctacgcctgtcatgagcgntgcttggcggcttaanattggacaacaacaagcttaccagagtacctggtgggctggcagagcataagtacatccaggttgtataccttcntngcgc

SEQ ID NO: 28185 - DNA, 500 bp, Homo sapiens
  misc_feature 469: n = A,T,C or G
agaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgnctggctgcacccctttttcccgcccccagat

SEQ ID NO: 28186 - DNA, 201 bp, Homo sapiens
  misc_feature 74: n = A,T,C or G
ctcaacacccactccctcttagcccatattgtgcctattgccatactagtctttgccgcctgcgaagcagcggngggcctagccctactagtctcaatctccaacacatatggcctagactacgtacataacctaaacctactccaatgctaaaactaatcgtcccaacaattatattactaccactgacatgactttcca

SEQ ID NO: 28187 - DNA, 252 bp, Homo sapiens
gaaaatagaggaagcctcaagccaaggaatgtaggcggcctgtagaacttggaaaaggcaaggaaactgatcctcccctagagctcccagagggaaacacagccaacactttgagttcagcccagtgagacctgtcagacttctgacttacacaactgcaagataataaatctgtgctgtttgaagcttgtgctaatttattatagcagcaacagaaaaccaacgtaataaacattttctccatttttacac

SEQ ID NO: 28188 - DNA, 280 bp, Homo sapiens
tcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggat

SEQ ID NO: 28189 - DNA, 230 bp, Homo sapiens
cgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactac

SEQ ID NO: 28190 - DNA, 130 bp, Homo sapiens
  misc_feature 23: n = A,T,C or G
gcgtcgatgaagaacgcagctanctgcgagaattaatgtgaattgcaggacacattgatcatcgacacttcgaacgcacttgcggccccgggttcctcccggggctacgcctgtctgagcgtcgcttatg

SEQ ID NO: 28191 - DNA, 438 bp, Homo sapiens
ctaggtcggttctctcctttccgtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattac

SEQ ID NO: 28192 - DNA, 318 bp, Homo sapiens
  misc_feature 87, 152: n = A,T,C or G
aatcagatgtgtcactaaacacactgcttggttcagctgacttttttttatacaagaagacattggtaaagaagaaaactgtgtgtnggtttacattctggcacaagcttcttattttgtagcagattggcaccttaaggagcattactttnaatatccaagaaaaaagtagattcctagtaaattactaatgaatgagttgtaggatatttgttcctgtcaactattatataagtggagtaaatacatatttttcttttgttaaaattcacccattggtactttggcctagaaagggtattatactaaatcttaaga

SEQ ID NO: 28193 - DNA, 366 bp, Homo sapiens
  misc_feature 24: n = A,T,C or G
gcaaggagctggccagccagcctnatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtggga

SEQ ID NO: 28194 - DNA, 372 bp, Homo sapiens
  misc_feature 24, 25: n = A,T,C or G
gtaaactaaaaaaggcatttttgnngccaaaaaagaactgatggcttggctgagatctgcagagcaccagagactggctggggaccaggtgatcctggacaaatcagtaacctttatgagtcttgacgtccacagctggacaatgggaatgacagctctcagagtcgtggttggaatgaaatgagaaaatgcgtgtggagcccttagcgctcaaggaactggcgctgaagtactcaatgaacgccgtcaggttctgaacagctggtagatgggctggcttactgaaggacatgattcagactgtcccggacccagcagctcatatcaaggttattccaggatctttggagacccgaggagagccgtgttgac

SEQ ID NO: 28195 - DNA, 351 bp, Homo sapiens
  misc_feature 21: n = A,T,C or G
gcttaagcggagggagtcganccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggctgaagaagagagacaaaaagaacaaaactaagaaga

SEQ ID NO: 28196 - DNA, 333 bp, Homo sapiens
  misc_feature 13: n = A,T,C or G
ggcctattcaagncattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttg

SEQ ID NO: 28197 - DNA, 113 bp, Homo sapiens
  misc_feature 8: n = A,T,C or G
ggagcagnaagggcaaaagctcgcttgatcttgattttcagtacgaatacagaccgtgaaagcggggcctcacgatccttctgatcttttgggttttaagcaggaggtgtcag

SEQ ID NO: 28198 - DNA, 247 bp, Homo sapiens
  misc_feature 10: n = A,T,C or G
cttttcagancgtggaggtgtggaaggagtggctgctctccaaactatgccaaggcggcggcagagctggtcttctggtctccttggagaaaggttctgttgccctgatttatgaactctataatagagtatataggttttgtacctttttttacaggaaggtgactttctgtaacaatgcgatgtatattaaactttttataaaagttaacattttgcataataaacgatttttaaacacttgtga

SEQ ID NO: 28199 - DNA, 485 bp, Homo sapiens
  misc_feature 9: n = A,T,C or G
aggctcagnaataaagggatggagaaagctctatcgagcaaatggaaaacaaaataaagcagaggttgctattctatttcagacaaaacagactgtaaaccaacaatgattcaaaaggacaaaaaaagggcattacataatgataaagggttcaattcaacaagaagacttaacagttctaagtatgtatgcacccaataagggagcacccagatttataaaacaggttattagagaactacaatagtgggagacttgaacactccactgacatttctagagagatcactaaagcagaaaaccaacaaagatatttgggacccaacacttgaccaaatggacctatgagacatctacagaatatttcacccaacaacaacagaataaacattcttctcatctgcacatgacacatactctaagattgactacacacccattcataaagcaattctcaaagaattcaaaatagctgacatcatacc

SEQ ID NO: 28200 - DNA, 423 bp, Homo sapiens
  misc_feature 34: n = A,T,C or G
gtgtatcaagagaaagacaggagtcaaagtatanttccaaaacttttgaacagaacactggatgaatactgtttactgagatggggaacacttagagaaaaatgcatttggaaagcagaaatacgatcaagacttccatttttgatacattaagcttggtatgtttaattcatagctatatagaggtattaaattggcaggacaaaatcatagctagagataaaaatttagagttcaccagtgtaaagatgatatttgatggcacaggatggactttcttctgggatttgagtatacatagaggaaagatgtgaggattgagcaccaggggacttcaacattgacaggctcaacagaggagaattcccaagaggatgaggttccacctttaggaccgccaaagaagacttcccagacaagtac

SEQ ID NO: 28201 - DNA, 323 bp, Homo sapiens
  misc_feature 4, 6: n = A,T,C or G
gacncncttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttt

SEQ ID NO: 28202 - DNA, 188 bp, Homo sapiens
aaggtccgttaaattaaacattttgtgggggttgttgacttgtatgtatgtgatgtgtgtttaattctaggagtacagctgatgaagaacttgcttgacaagtttttaacttatgtattatttcgaagcagtgtttacgtagcagtaacatgaaggtttctaataaaatacccaatgtacacagcgcc

SEQ ID NO: 28203 - DNA, 421 bp, Homo sapiens
agagtcgttatagaaagttgaatctttgtcttctattgaatgcttgaaatttagctaaaagtgtctcaggagatgggctaccttctgtgtttagtactgtctatcttggtgtgtacagaattgggacttggcaggttgaccttccctctggattcagaaagccccaggacttcttataaagttaggccatgggtcgtcttggaggcttgggtctggtaaataattgagcctgagctcacaatcctgcccctgggtccaggtggctggtctgctgcccccaaaagcctgaccttcttggtcctgtgggtctgtcagtaaggcaggtagccatagctggagagagacagtcaccaggctgggatcttggacagtccctccatctctggttcatcctggcctaggcagggcatggagtagatgg

SEQ ID NO: 28204 - DNA, 190 bp, Homo sapiens
agagtgagacactgtcacacaaaaaagaaagtaaatatcacaatatgtcacaataggccgggcgcagtggctcacacctgcagtcccaaagtgctgggagtataggtggtgagccaccacgcctggcctaaatgaagtaccacatgaccgaccgaccgacctggggaacatagcaagaccccatctctac

SEQ ID NO: 28205 - DNA, 450 bp, Homo sapiens
  misc_feature 6: n = A,T,C or G
aatgangaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcaggcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaaatatattgtga

SEQ ID NO: 28206 - DNA, 456 bp, Homo sapiens
  misc_feature 4, 30, 57: n = A,T,C or G
ccanccgcaatgggaataagaggtggggcntttaggagatgattaagtcatgagagntctgccctcatgaatgggattagtgccttacaaaaggcatgaaagtggcttttttgccacttctgccatgtgaggacacaacattcatcctctctgcaggacacaaaaacaagacgctatcttggaagcagagagcaagcaagtctagcagtgccttgatcttagacttctcagcctccagaactgagagatataaatttgtattatatataaatgacccagtctaagatattttgttgtagcagcagaaatggatgaagatgcttgccaaccaaagttagtaatatgtaaacctatggctaatgctacaaatagtttatgagggaatgctctacaagtctcagaagtacagctcttttactatggaatatttagttataagcctgcaggtaatggaga

SEQ ID NO: 28207 - DNA, 458 bp, Homo sapiens
  misc_feature 29, 30, 31: n = A,T,C or G
ggaacccacccagtgtggagcagcccagnnnagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtaggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgt

SEQ ID NO: 28208 - DNA, 256 bp, Homo sapiens
  misc_feature 6, 31: n = A,T,C or G
aggctnagtgtggttgctcacgcctataatncctgcactttgggaggcaacggtgggaggattgcttgagctcaggagttcaagcccagtttgggcaacatggcgaaaccccgtctctacttaaaaatttttaaaaattagccgggtatggtggtgcatgcctatggtcccaactactcaggaggctaagacaagaggatcacttgagcccaggatttcaagaccagccagggcaacatagtgagaccccatctct

SEQ ID NO: 28209 - DNA, 490 bp, Homo sapiens
  misc_feature 5: n = A,T,C or G
caggncgattccttgaggacaaagcacgttagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactactttgagaacatgcacaatagtatgtttttatta

SEQ ID NO: 28210 - DNA, 149 bp, Homo sapiens
ctgaaaagaagcctgcagagaagaaacctactacagaggagaagaagcctgctgcataaactcttaaatttgattattccataaaggtcaaatcattttggacagcttcttttgaataaagacctgattatacaggcagtgagaaacat

SEQ ID NO: 28211 - DNA, 276 bp, Homo sapiens
  misc_feature 34: n = A,T,C or G
catggccggctcacccttgtaatcccagcacttngggaggccgaggtgggcaggtcacctgagatcaggagtccgagagcagcctgaccaacatggagaaaccccatctctactaaaaatacaaaattagccaggcatggtggtgcatgcctgtaatcccagctacttgggaggctgaggcaggagaatcgcttcaacctgggaggcagaggttgcactgagccgagattacgccattgcactccagcctgggcaacaagggtgaaactccatctc

SEQ ID NO: 28212 - DNA, 488 bp, Homo sapiens
  misc_feature 7, 17: n = A,T,C or G
ggatcancccccaaaanattgggcctacagcttgggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattg

SEQ ID NO: 28213 - DNA, 385 bp, Homo sapiens
  misc_feature 22: n = A,T,C or G
cccatgagaaatgttgaatttntgaagaatagattttaaggctttgaaaatggttaatttctcaaaaacatcaatgtccaaacatctaccttttttcataggagtagacactagcaagctggacaaactatcacaaaagtatttgtcacacataacctgtggtctgttgctgattaatacagtactttttcttgtgtgattcttaacattatagcacaagtattatctcagtggattatccggaataacatctgaaagatgggttcatctatgtttgtgtttgctctttaaactattgtctctcctatcccaagttcgctttgcatctatcagtaaataaaattcttcagctgccttattaggagtgctatgagggtaacacctg

SEQ ID NO: 28214 - DNA, 463 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacata

SEQ ID NO: 28215 - DNA, 469 bp, Homo sapiens
  misc_feature 7, 34: n = A,T,C or G
ataatanaggaatgatacaagattatattatttnggagaaaactcgaggaccaagatatagatgacaaatctatttataccatgaaaggcccttcctaacatttaaaattctggtccccaaacaaagctaattaaaataatagttctctgttttttattatgtactaagctgcctaaaagtaggaaggtaggaagtaaggccaggcatggtggctcacccctgtaatcccagcattttgggaggctaagacaggaggattgcttgaggccaagagttcgagaccagttggggcaacatagtgagaccttgtctctacgaaaaattttaaaaatttacccaggtgtggtagtgtacaccaacggtctccagctatgcaggagactgaggtgggaagattgcttgagctgagacgttgaggccgtagtaacctgtgatcgcaccactgtgttctagcctgggtgacagagc

SEQ ID NO: 28216 - DNA, 189 bp, Homo sapiens
  misc_feature 29: n = A,T,C or G
tgtgccggctcctgcaaatgcaaagagtncaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatat

SEQ ID NO: 28217 - DNA, 188 bp, Homo sapiens
  misc_feature 6, 30, 56, 184, 185, 188: n = A,T,C or G
aaaganaaatttgaaatctggttaggctgntgttagggttctttgtttttggggtntggcagagatgtgtttaagtgctgtggccagaagcggggggagggggggtttggtggaaattttttgttatgatgtctgtgtggaaagcggctgtgcagacattcaattgttattattatgtcctacnngcn

SEQ ID NO: 28218 - DNA, 101 bp, Homo sapiens
  misc_feature 33: n = A,T,C or G
atttagccctttaataaaagatgatcttcatanattacagaaagtttgcttaccctgtttgaccttttgcagaaaagaacaagagggaagacagaccttca

SEQ ID NO: 28219 - DNA, 407 bp, Homo sapiens
  misc_feature 24, 26: n = A,T,C or G
aatatgtggagatgtcagacagtncnaaatgagagcgaagtgtcatttaccgaaaaattcttatgcaagaggcacaattattcactgctcagaatctattttctcatttaatccttccaacaacccagtaaagtagatattattattacaaaacctattttacagatgaggaaactgagacttagaaagattaactattttgcctgaagttgccgagttggtggatgacagagccaggacttaaaattaggtgtacatgattctgtgctcttaactacaaaattacattgtgtgtaagtatgagtagggaactcaaaaaagagttctgggctagagatagagatttgggagttacctgcaaaggagtgatagatgatatatggctgtagacagagagcgagggaaga

SEQ ID NO: 28220 - DNA, 240 bp, Homo sapiens
  misc_feature 7, 32: n = A,T,C or G
ggcgacnaacctaccgagcctggtgatagctngttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacca

SEQ ID NO: 28221 - DNA, 216 bp, Homo sapiens
gactctaaagaccaatgtttggccctaactggactaatatgtatctttctgtgatttcatcatagaggtctgttttgtgagggtttggggtgcagaaaactttgattaaatcttaatgggaggctgggtgacctggattatctacagtgagcagacttaaatggaacagaagtttatgtgtccaaatgatggaatcattaaacctgagtgacttac

SEQ ID NO: 28222 - DNA, 197 bp, Homo sapiens
  misc_feature 5: n = A,T,C or G
tagantcttagttcaactttaaatttgcctcagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgttcaagctcaacacccactaccc

SEQ ID NO: 28223 - DNA, 418 bp, Homo sapiens
  misc_feature 15, 27, 28: n = A,T,C or G
acgtcccaagtaacnggccccagcctnnaggcccccaactccgcccagcctctccccgctctggatcctgcactctaacactcgactctgctgctcatgggaagaacagaattgctcctgcatgcaactaattcaataaaactgtcttgtgagctgatcgcttggagggtcctctttttatgttgagttgctgcttcccggcatgccttcattttgctatggggggcgggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgc

SEQ ID NO: 28224 - DNA, 119 bp, Homo sapiens
ctttggatttaaaaacaaaaacaaaagttggacccaaaggatgtgaaacctgctgataatggatccacgcgtcataatatgtttaaagaggaaatactgatgataattaagttctattt

SEQ ID NO: 28225 - DNA, 274 bp, Homo sapiens
agcctacggcaactaaaatccgtagatttcttgactgtcctgaacagggaagaaaatggaacttttcagcgtgcatgtgctttggcacatgcagtcataagcaaagaaggtatttgctcatggtattgataggtgatgggtggtagaggatatttctagcctggagttgggtgtggcatggattcaacaaatatttgcttattgctaacatctaaatttaagtgttacagtttcagtaaaatataatgtttgatttagcagcttcaattatagc

SEQ ID NO: 28226 - DNA, 425 bp, Homo sapiens
  misc_feature 10, 39: n = A,T,C or G
agctgccagnagtccgaacacagtttgctgattccaagnaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcaggtggccttatttg

SEQ ID NO: 28227 - DNA, 470 bp, Homo sapiens
cttcagcagtaaagttttttaaaaagtacagcttctttgttgatttcccaaaagtaagccccattttcaacaagaggggaaaagcaagcattaaaatgtggatgtgattattgtaatacacagttttatagtttgtgagcagtaaaccaatcatctctatcccatctttctgtcttctgatgtataaatcctggaatctggcaattctagcttagaaaaacccatagtgtgcttttgactttgaagctttaaaaattgtgttatatgccattaaaaaaagtaattccatgattccactagagtataaggtccatgaggtgaggaatttttgtctgctttgttctctgctttctatttaatgtgtagaatagtgcctggtacatactaggcactcaatcaatattttaaaaataattgcataaattcttgcctttaatagaaaaagtaaagtttttcatgtcagtgaatta

SEQ ID NO: 28228 - DNA, 455 bp, Homo sapiens
  misc_feature 6, 47: n = A,T,C or G
gtatanatatatatatgtacagttatctattttaatttaaagttgtntgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttagtgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtat

SEQ ID NO: 28229 - DNA, 164 bp, Homo sapiens
  misc_feature 10: n = A,T,C or G
gctcgacagnatgcggcaccgatccttagccttagaactctctggaaccattaaagagatcctggggactgcccagtcagtgggctgtaatgttgatggccgccatcctcatgacatcatcgatgacatcaacagtggtgctgtggaatgcccagccagttaag

SEQ ID NO: 28230 - DNA, 160 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccc

SEQ ID NO: 28231 - DNA, 129 bp, Homo sapiens
aaagaacccatgggactgatgtcatcttgagctcttcatttattttgactgtgatttatttggagtggaggcattgtttttaagaaaaacatgtcatgtaggttgtctaaaaataaaatgcatttaaac

SEQ ID NO: 28232 - DNA, 489 bp, Homo sapiens
  misc_feature 6: n = A,T,C or G
aggatngttcttgttatcctatgctgtttgtaggatgaccacatcctacgaagaattatttttttcaaaattgtaatgtgaagttaattttctttatgaaagacacactcagccatagtatattaatctgcaacctaaaatttaattaggttatgcattgtacattttctcaatttatccattctctagtcttattttcccaaatcctaggcttattagaatgtaaatgtaaaattttcattataacccttttgcttaaatatttttgtggagctagcaatggtggcccacgcccataaccccagcattttgagaggccaaggcaagatgattgcttgggtccaggagttcgagacctgcctgggcaatgtagtgagacctcgtctctactgaaaatttaaaaattagccaggtgtggtggtgcacacctgtagtcccagctactctggaggctgaagcaggagaaccacttcactccaagagatcaag

SEQ ID NO: 28233 - DNA, 194 bp, Homo sapiens
ggatatcaaggtggaaatggcccatttaatgattgattatatcattttgtggatatagttataatctgatgggcctggctgggagtggaagaagggaagccttttgcaaatagtagagtgtcagttgcaggtgccaatgactaactttttgaattctatgttggcattaacaataaagcattttgcaaacactg

SEQ ID NO: 28234 - DNA, 490 bp, Homo sapiens
gagtccggaaagacaaatcttcgccgatgttcttaccttgtattggacgaagctgacagaatgcttgatatggggtttgaaccccagatccgtaaaattgttgaccaaatcaggcctgataggcagacactgatgtggagtgcaaccctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatcctt

SEQ ID NO: 28235 - DNA, 490 bp, Homo sapiens
gggggctgaaggctagcaaaccgagcgatttgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagc

SEQ ID NO: 28236 - DNA, 460 bp, Homo sapiens
  misc_feature 2, 7, 33: n = A,T,C or G
gnaggcncatggggttttccattgtggttggtnaaaatgggtacgattcccagccttttgtgagccctggtggtttaattcccttaatcattttgggtggttctttccctggccttcggtagtttcttcacacacaagtgctgagcggtacgcagctgaaggcttgagggagtccatcttgcaggtcagtcgtgttcttagtgggtcagactctcttctggtgatctgaccagcaaacctcattgctttggtgcttccccagacttccagtttcatctcccaaactcagggaaactgctgggctccctctgagttccctgtcctccctttttttgtgacctgtaaagtgttttccatcagtaaactgggacagttgtagggcttacctagtttgtttttttaatctctcaattatcagttttcttcattgcctgatgtccagttccttgaaaaccattat

SEQ ID NO: 28237 - DNA, 224 bp, Homo sapiens
  misc_feature 16, 52: n = A,T,C or G
gataaaattaatggangaaacctataagagtgatggggcaagaggaaggcangctgctttgtgcaactgtatctcctaatatctttatcaaaatgacatcataaggatgtacagcgaaggtggtaaccctctgtcattccagagaaaaagggatataggtagtgcagcctgaggttctcaaggcatggaggaaaaacgtttcaaaaacagaaaagaaccatttg

SEQ ID NO: 28238 - DNA, 180 bp, Homo sapiens
  misc_feature 7, 20: n = A,T,C or G
cttggcngaagagagaaagnatggcaggccttgaaaaagtattcaaagaaatatttggtaagaagtttcccaaatttggtcaaaggtgtaaacccacacatgacagaaactgagcaaatcccaaacagtataaatccaaagaagtccacagcaagagacatcatagtaaaatttttgaac

SEQ ID NO: 28239 - DNA, 414 bp, Homo sapiens
  misc_feature 21: n = A,T,C or G
ctctgactgaagtagaacagnaaccaaaatggttctcaggaaggaatgccagtgtttcccaagacctcctggagatgcactcacaccagactgcacagacccctccacattatgccacacacggcctagacgttgtgtttcctcagccattttccctctgctgccccagtttactctgtccaaaaccctaaggttcttctctcacttgaacacagacgaccttgcttgggtgatgagacatcccctttatctcttcctctactgctggccaagacccgtcactttataagaagctcagatgcagcagtgctggagagctctctctttatgcaaaaatctcatttcaccaggagctttcagaagtttcacctgggctaaattcagcagcatttctgttaggatatttagatggga

SEQ ID NO: 28240 - DNA, 463 bp, Homo sapiens
  misc_feature 4, 6, 387, 463: n = A,T,C or G
gttncnagaaaactttaacaaaagctggcagctggctagatttggcttgtaaggtgctatatgctgacccctgcttattaactaaagtcagtattgcattctgttttgcctgttcatatctatgaagacttagaattcttattcatcctttctgggattcaggtgccacatgggcagagaaacgtggtttctatcaaatcatctatataaaatactttataagtgaaatattacttgaatcctttgagatgttacaagttttttttttccttgagtcatgctaatagatggttcaatacatgaatgagtcccttgctgaaatgctttaggacttcagactaccctgaacgttgattactctttatactgaaataggcattattcagnggaagagagggaagaccaaattgatagactggactttattcgaaaccagatgaaccttttaacactggatgttaan

SEQ ID NO: 28241 - DNA, 255 bp, Homo sapiens
ggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaaggggggagaaaagaggtgttagggtttggggtttttttgtttttgtttttgttttttaatttcttgatttcaacattttctcccaccctctc

SEQ ID NO: 28242 - DNA, 462 bp, Homo sapiens
  misc_feature 31: n = A,T,C or G
ggttcaaacttttgggagcacggactgtcanttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctcccctttgttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatctttcaaaataaaaagtaatgacttagaaactat

SEQ ID NO: 28243 - DNA, 211 bp, Homo sapiens
ggaggtcaggagatcgagacctcctggccggcgtggtggggccccatctctactaaaatacaaaaattggctgggtgtggtggggcacgcctgtggtcccagctgctcgggaggctgaggcaggggaatcgcttgggcccgggaggaagagattgtagtgagccaatatcacaccactgcactccagcctggtgacagagtgagactgtcg

SEQ ID NO: 28244 - DNA, 102 bp, Homo sapiens
ggaatctgtgcatctgctgcatagggacaggaagatgatgataatggataggagttctttggggttccatctttctgtacatcccaggccataagatgatgg

SEQ ID NO: 28245 - DNA, 432 bp, Homo sapiens
  misc_feature 30: n = A,T,C or G
attatccctgaacctactttaacttccttnaattcagaatcaatgaatgaaattctatttgaagaataccagtttcaagcagtattaagagtaaatgctggggctctcagtgcacataggtatttccgagataatccttccgaattatgctgtatcattgttgatagtggatattcctttacacatatagttccttattgtagaagtaaaaagaaaaaagaagcaattattcggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttg

SEQ ID NO: 28246 - DNA, 150 bp, Homo sapiens
attacccaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtc

SEQ ID NO: 28247 - DNA, 120 bp, Homo sapiens
  misc_feature 120: n = A,T,C or G
tccaggtgggaagagataaaaagacattaattagttgtttatcaagtgacatttagttgtttggttttgggttttctttttttgattgcgatttttcctctgattaaaaaaataatattn

SEQ ID NO: 28248 - DNA, 206 bp, Homo sapiens
  misc_feature 11, 204: n = A,T,C or G
cacaacccagnacccctccacacaaacccagatggggctgtgccgctgttttccagatgtattcattcaacaaatatttgtagggtacctactgtgtgtcagatgatgttcaagatcagcatcatccgatggaaatagcatatgagccatgtatgtagtttcaagtttttcattagccacattaaagaagtaaaaggaaacaantg

SEQ ID NO: 28249 - DNA, 140 bp, Homo sapiens
  misc_feature 140: n = A,T,C or G
agtacatttatttttaaaagatattagctgaaatggatggtggagctgaaaaaaaagagaggggcttcaaaaaagcaaatttggacaggcatgtattggtggaaaaggtgctgaatgagaggaatatgaacactctgctn

SEQ ID NO: 28250 - DNA, 335 bp, Homo sapiens
gatggacaatggagagagctttccctgtgattataaaaaaggaagctagctgctctacggtcatctttgcttaagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagc

SEQ ID NO: 28251 - DNA, 483 bp, Homo sapiens
  misc_feature 25: n = A,T,C or G
aaaagaggatacaaacaaatggaanaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccaaaaaagggcccacattgccaagtcaatcctaagccaaaagaacaaagctggaggcatcacactacctgacttcaaactatactacaaggctacagtaaccaaaacagcatggtactggtaccaaaacagagatatagatgaatggaacagaacagagccctcagaaataacgccatatatctacaactgtctgatctttgacaaacctgagaaaaacaagcaatggggaaaggattccctatttaataaatggtgctgggaaaactggctagccatatgtagaaagctgaaactggatcccttcct

SEQ ID NO: 28252 - DNA, 436 bp, Homo sapiens
  misc_feature 7: n = A,T,C or G
ggaaacngggaaagaaagcaaggccctttttctgcctttcccgggatctgtctactccacctccacgggggaggccagtggggaagggctgtcacctcttccccatctgcatgagttctggaactctgtcctgttggctgcttgcttccagctccccccaatctccatcgcagcgggttcctcctgtcttttctacagtgtcataaaacatcctgcccctaccctctcccaaaggtcaattttaattctcaccaagttttgcacatctctgtatgtcgcttgatgtcttagacgcgagccctttcctaaactgttcagcgctctcttttcctttgggtggttgttgcaagggtgatgacatgactgtccccaggcctgtctccctgaagcgtctgtgctgtcaggacagccctgggcagagatgaggcaggggtga

SEQ ID NO: 28253 - DNA, 190 bp, Homo sapiens
  misc_feature 7: n = A,T,C or G
aatgganaaacaatgcttccagtggccactttctaaggaaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatgg

SEQ ID NO: 28254 - DNA, 222 bp, Homo sapiens
  misc_feature 6, 29, 157: n = A,T,C or G
cacctncctttaccgatactgcagtgggngctatacatatattgagccatttaatcatcagaatagcttgctaggtaagtggtattcaccctatattacagataagggaactgagggtcagaaggagtaaataactagtattaagtggtgctatcangaatttgaatctagatttgttgtattctaaagcctgtggttttggggaagaaactgaattatgtt

SEQ ID NO: 28255 - DNA, 383 bp, Homo sapiens
atgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaaga

SEQ ID NO: 28256 - DNA, 426 bp, Homo sapiens
gctgggctcaacagggcagttctgctgctcacacctgggatccctcatggagccaaggtcagctgttacctcagctgggcctggatggtctaggatagccttactcacttgcctggcaggtgacaggctgttggctggaattgcttggttctcctccatgtggcctctccagcaggctagcccaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatg

SEQ ID NO: 28257 - DNA, 426 bp, Homo sapiens
aaatgggggagctagaggctaccacgcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctagcctttgatttttaactccaaaaatgagaaacattttaaagcatttcatttacgaaaaactgtctcaactattcttaagtactgtattgatattgtttgtatcttttattaatgttctaccactttttatagatttgcatcttcctgtcacagggatgtggggaaatatgttttcctcccaagagaaccaagtttattatagactcctttattcagtg

SEQ ID NO: 28258 - DNA, 475 bp, Homo sapiens
  misc_feature 6, 30, 58, 258, 311, 363, 403: n = A,T,C or G
gagtgnccctgttctgtagacttttctttntttttttaaccaaatccaaaggatgttncagaaaagctagccactggtattttgttttgttttaaaaaaaaaagaaagaaagaaagaaagaaaaacggaaaggaacctagctgcctgtatctttcatttttaaaatagcacttgagttattttctgagtaatccaataaagaacttttgatgacagccagaatgtgttagaactctggctgaacatttcatctcctgngagtcagaagggctttatttctccctttgatggggccccttcttctttctggngctctggaagttgtttagaggaaagaattctaattttaattaattgcgcagngagttaatctcactcccttttctgcttccaggcatcttangaaaaacaaatggttttagtagataagggatgcctaccaatgtttttttaaaacaaacagggacatttttat

SEQ ID NO: 28259 - DNA, 315 bp, Homo sapiens
atttgatttttaatttaaccaaagtttggaaaaaactaattaacaaatgcaaagttttaaaattataatccaaattgatatacttacctagctcccaatatatccttcttggcaaggcctattccggctataactcttactctcacaattcgtgaattttcctaaaatacaaaaatttagatttcattttcatgtacttatgagttaactaagacacaattttttaaaaaatatatatcaaataaagtaattaggatattaaaattaattgaagaatctttttcaataattaattttattaaaagttacagggga

SEQ ID NO: 28260 - DNA, 412 bp, Homo sapiens
  misc_feature 2: n = A,T,C or G
gnaaggggaggttcaacaggtgccttctatagcagagttggttgttaagtcacactacccacaacatgctacccacaataaccacagaagaaaggttacacatacataggtctgttctcccttttatgctcacttaccacacaaatgacatctttgtgcctgttgttcggggtcattgcctaaaaaagttgagttgaaactggcaatgaagaaagaatgggccgggcatggtggctcacgcctgtaatcccaacactttgagaggccaaggcgggcggatcacctgaggtcaggagttcaagaccagcctggccaacatggtgaaaccccgtctctactaaaaatacaaaaaatcagccgggcgtggtggtgtgcctgtaatcccaactactcgggaggctgaggcaggaga

SEQ ID NO: 28261 - DNA, 170 bp, Homo sapiens
  misc_feature 13: n = A,T,C or G
caagaaaaacttnaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgcg

SEQ ID NO: 28262 - DNA, 267 bp, Homo sapiens
aagactatgagtatccctaatctttaacatgggttaattggatggtggggagtatttgctttgatttcctgtgtataactcaccgatgggtttccattgtttgattttcttcgcggataggtttttcagattacaattagtctaaattagcctggtgcggtggcacatgactgtaatcccagcactttgaggaaggctaaggcaagcggatcgcttgagctcgaattcaagaccagcctgggcaacatggcgaaaccctgtctctac

SEQ ID NO: 28263 - DNA, 333 bp, Homo sapiens
ggaagaagaggttgagaagtacaatccccccttgactggtcttcttcctcttttgttcctttgtactttatttcccacaaggaagctaaactgatctcattaaggtagaaattagtttatgttgctttctccaatggctcctatagcacttagaataaagcccctgcttcttacccttgccctcaaggtctgcaggaactgccccctgaacaatgcattataagtggacacagtggcggtagcatggctagttgggaggtcattatagtcacctagggaagaaatggtggtggcttggcctaaggtggttatagtggagatggaaaggaactg

SEQ ID NO: 28264 - DNA, 460 bp, Homo sapiens
  misc_feature 8: n = A,T,C or G
gacttagnagaaagaaggaatggtcttccatgaactgattatgcttaattaagcaaagtaaggaaattagtttcatggaagcctaaacaaggctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattat

SEQ ID NO: 28265 - DNA, 315 bp, Homo sapiens
aaggctttcccctgtaacaagccgagccctccaaggtaccagactcttcttactacacaggtactaacaggctggcaggttagagttggtggagtctgaggagagatattttctctttgttgccaacatcctgtttaccaaaagtgtcaccccaccatcttccataagctgtgaaacaaaatcaatgaggtcactaacttagaagggaaagaaagttttctgggtctttgttttcttgatttggggtaatttatacaagggcatacaagttgattttaagatgtggaactgggaggtagactagtttggataaga

SEQ ID NO: 28266 - DNA, 438 bp, Homo sapiens
  misc_feature 7: n = A,T,C or G
tcggccnttatggcccgggtctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgac

SEQ ID NO: 28267 - DNA, 488 bp, Homo sapiens
  misc_feature 7: n = A,T,C or G
tcggccnttatggcccgggcctaccaccacctaggtgattatgccttttaaatacttaaaacataaaggcacacaactagaaaggaaaagcaaacgtcatcaccttatgattagcattttcaacctccaggagggtggagtggagttcttggcattgggtgaaatgggaagctttctgatttgggagatactttccaaagggtagcaggtttagcttctacccagtcagtgtttgaagtccacagaaattgtggtctgaattctcatgacattgcagtgacctcatgagacattacctaggtagacttgaggctactgttgaattcctccctcttgggaatccaagtgtggatgcactgtgtacctttattgcctgagcttacaaaatcaggtgtgtgactttataatctgaaagacggccttcccctgtccataaaactgctgggaatgttagcagttttaatgaaactcttccattttctaggtga

SEQ ID NO: 28268 - DNA, 466 bp, Homo sapiens
ggggcattcctgttacaggaccaaggagaactggagaaagaaagagaaaatcgttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactt

SEQ ID NO: 28269 - DNA, 377 bp, Homo sapiens
gcattatggccgggcaaggaagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtatttaaagttatacagaaaatagaataaagttaataccaaac

SEQ ID NO: 28270 - DNA, 416 bp, Homo sapiens
  misc_feature 3, 4: n = A,T,C or G
aanntcggccattatggcccggggattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagc

SEQ ID NO: 28271 - DNA, 167 bp, Homo sapiens
  misc_feature 3, 167: n = A,T,C or G
ganctatggaccctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtn

SEQ ID NO: 28272 - DNA, 201 bp, Homo sapiens
  misc_feature 3, 11, 35, 39, 40, 49, 82: n = A,T,C or G
aanctcggccnattaatgggcccgggccgaactcnttanncggtgggancacctccggcctccgtgccgtcgatgaaagaancgcagcctagcctgcgagaattaatgtgaattgcaggacacattgatcatcgacaccttcgaacgcacttgcggcccccgggttcctcccggggctacgcctgtctgagcgtcgcttgt

SEQ ID NO: 28273 - DNA, 147 bp, Homo sapiens
  misc_feature 15, 60, 95, 107, 114: n = A,T,C or G
tgtgacaactcaaancattttcagatgtgatagaatggcccatggtggtgtgagggggcnaaatccccaaccccccagttgagaatcactggttnataccaacacantctcagnagcatacgatttagtcccctttcatgttgctga

SEQ ID NO: 28274 - DNA, 333 bp, Homo sapiens
tatggccgggctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggat

SEQ ID NO: 28275 - DNA, 468 bp, Homo sapiens
gagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaataga

SEQ ID NO: 28276 - DNA, 275 bp, Homo sapiens
gttgttggtgtgtggctttatttctgggttctcaattttgttccattgagctacatgtctgtttttgtactagtaccgtgctgttttcattactgtaaccttatagtgtcatttgaagtaggtaatgtgatgcctccagctttgttctttttgcttaggattttctttagctattcaggctcttttttggttccatgtgaattttagaacagttttttctaattctgtgaaaaatgatgttgatactttggtaggaatagcattgagtctgtaga

SEQ ID NO: 28277 - DNA, 462 bp, Homo sapiens
caccctcagcttccaagtagctggggctacaggctcaggccaccatgcccagataatttttgtattttttatagagctggggttttaccatgttgcccaggctaaatgtttttaagcagggtggaacatgatcagatcttttaaaaagaattctgatagtaattctgatagaaatttggaggtaaagaaagtgagaatagttaggggatattataagtaaaaatttgtgattttttttctccttctgccctaatgtctttctctcaatcacacagtggtagcatttagaaaaacatctttacctccaaacaagagggacacaaccaaatcaaagtgattattagagacactttgtcctggagcctgctaaagagcataccccttccttgacctatttagagatactctgtggactttgttcaagaaagaaagcataacagtaatgttccctggttgacttga

SEQ ID NO: 28278 - DNA, 393 bp, Homo sapiens
atttccctttaggaaaaacgtcagctgcttgtaaccactgtgtttatgtcaaagcattcattttttttaggatatctgaaaaaatgccatataagagaaaactctataaaacatctataattttcgaacccaagtacactcttgcattctatgctttaagttaaatgcaaactcctttttccttcttcctgctgcaagtactatctcatcctgatgctctagagtgtcagggcctgggtttccaaacagagactaccctaaaattatttggggagtagtactttacgcaattgcctctcccccacaaatcataattgtttcagtaaaatggttacttggtttttccaagaaaaaactcgtttttactcatttttggcctgtttgtttatttag

SEQ ID NO: 28279 - DNA, 397 bp, Homo sapiens
ctactaccacaagggaaaatagtttaggagaaaccagcttttactgtttttgaaaaattacagcttcaccctgtcaagttaacaaggaatgcctgtgccaataaaaggtttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctattttttttg

SEQ ID NO: 28280 - DNA, 314 bp, Homo sapiens
aactataaagatcctgctggccctttctcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatacta

SEQ ID NO: 28281 - DNA, 350 bp, Homo sapiens
cagtgaagtaaaatttacctttttctattactgaagggttcagctggtccaaactttgtctaaataaagttatatatgtagcttaaaatatttaagagaagatgtctagtacattagaagtaggacatatacatgcaaacagataccatattgattaagagttcttgtttatttcatgaagcaggacttttccaacttaaactgaaaaaaaaataaaaaggaagaggaatatctttgaaggatgctcaggagaaaaaggaactctgagttctatgagtacttagaaatgaagtaacgaagatctgcttcttctcagacattcattttctcttacccttcattggttttat

SEQ ID NO: 28282 - DNA, 360 bp, Homo sapiens
caagttattccatggggagatatggccagcttagcccctgttgcagaggcaatttgatgtggacattcttatctcgggacacacacacaaatttgaagcatttgagcatgaaaataaattctacattaatccaggttctgccactggggcatataatgccttggaaacaaacattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagag

SEQ ID NO: 28283 - DNA, 305 bp, Homo sapiens
cattttggggtgaggaaatagagtacagaagtattagggccaaaaaactaaagaaacaatagaaactagcaacccaggtgtctcacggtgggtgactgttgtatgtaacagacaggaggataagagctgtgtcatttaagtcaaagtccaaagaagatgcgcaaggaactcagaatattcacaggagactataccagtgcctgatgcaagaaagcttatttaacaaccactgtgtgtgtgtgtgtgtgtacacatgcatatatttgttacatataacatgtatacatacataaacacacacatat

SEQ ID NO: 28284 - DNA, 328 bp, Homo sapiens
tatggccggggttctgtttatttaaacaactgaatacttataaactgttgttcctggaagttatttattccataaaaaatttgttcttttctcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttac

SEQ ID NO: 28285 - DNA, 410 bp, Homo sapiens
gaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgc

SEQ ID NO: 28286 - DNA, 386 bp, Homo sapiens
aaggcagtattgcctgtcacctgcccagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatat

SEQ ID NO: 28287 - DNA, 159 bp, Homo sapiens
gactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttac

SEQ ID NO: 28288 - DNA, 327 bp, Homo sapiens
aaaagaggttggtttcttaagttgagtgatgggcatgtagatattagcacgttgttctctttcttttcgttttctttttttattttcctcttgaggcggggccttgctctgtcgtccaggctggagtgctgggatcacaggtgcaggccatcacgccagcactttgggaggccaaggcaggcggatcatgaggtcaggagatcgagaccatcctggctaacatggtgaaaccccctctctactaaaaatacaaaaaattagctgggcgtggtagcgggcgccttatagtcccagctactcgggaggctgaggcaggagaatggcgtg

SEQ ID NO: 28289 - DNA, 317 bp, Homo sapiens
gattcttggaatgcaataagtatgtattgaactgtactgtaaagtagctccaaaacttaattactctcctgttttaggggttatacatttggactgtgcattctccaagagatgaagcggtgaagttgggatttacattggaagtgctgtagacttctttatgtggctcagtggagagagggaaagaatgttgcacctgctctagtaccataggtcaagaggcttctggatcacaaagtcataactagacaggtttgttcttgtagttttctatccccagtctttgctccccagatggcagtagtttttagtaggga

SEQ ID NO: 28290 - DNA, 389 bp, Homo sapiens
gggtataaaataatctctcttctggtttcaggaaagcatagagaaaaaaactaagattcttttctaatttttattgacccagctgaaatagtataatgtcttgcctttttaaggcacttaaacatttgtttagttgaattgtttgaaaggacagaggagaataggacattccatatttgaacagtataagtagaagaacatgaattgatggaggtggtagtatccttccacatttttttttctatcaggaattagactcctacagactttgtatcttaagaaagaaatgcagaatgttggtaaaatactaacagttttcaaatgatacctaatctaaatgttaattgaaatagaattcacaacaaatctgctcatgtaatcctgaatct

SEQ ID NO: 28291 - DNA, 347 bp, Homo sapiens
  misc_feature 1, 2: n = A,T,C or G
nnctaccattttatatgaaaaagaaaaacatttcttcctggaactcactttttatataatgttttatatatatattttttcctttcaaatcagacgatgagactagaaggagaaatactttctgtcttattaaaattaataaattattggtctttacaagacttggatacattacagcagacatggaaatataattttaaaaaatttctctccaacctccttcaaattcagtcaccactgttatattaccttctccaggaaccctccagtggggaaggctgcgatattagatttccttgtatgcaaagtttttgttgaaagctgtgctcagaggaggtgagaggaga

SEQ ID NO: 28292 - DNA, 161 bp, Homo sapiens
gatatctgaaaggatcatgaaacctgagaaatgctaatggagatttgctggtacataggaatctagcaaattcaggaaccaaggggaaatgttgtgagataacatttacattgtcaacctttattgactttgtttttacaataaaaaatattttacaactt

SEQ ID NO: 28293 - DNA, 220 bp, Homo sapiens
aaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagattttttttttgcaccccatgctgttgattgctaaatgtaacagtctgatcgtgacgctgaataaatgtctttttttt

SEQ ID NO: 28294 - DNA, 377 bp, Homo sapiens
  misc_feature 10: n = A,T,C or G
gaaaaaaaangtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttg

SEQ ID NO: 28295 - DNA, 287 bp, Homo sapiens
  misc_feature 12: n = A,T,C or G
aatgagtaaatnataaagccttcatcactcccacatttttcttacggtcggagcatcagaacaagcgtctagactccttgggaccgtgagttcctagagcttggctgggtctaggctgttctgtgcctccaaggactgtctggcaatggcttgtattggccaccaactgtagatgtatatatggtgcccttctgatgctaagactccagaccttttgtttttgctttgcattttctgattttataccaactgtgtggactaagatgcattaaaataaacatcagagt

SEQ ID NO: 28296 - DNA, 318 bp, Homo sapiens
ggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagaga

SEQ ID NO: 28297 - DNA, 326 bp, Homo sapiens
gtaatttcatgtgtaattatttagattgtttctctctgtgagaatagatatacacagcttcagttatgatgtagaaaatttagtcgggtagaagtggtgccgaagatttactcagcaaagatttactttgcttaatttggcaactgttcaaaattccacatagcctcatatacttggcactgaggaataggcataaatgtatttttatgagcattgacctattcgggacatatgctttcctcagatgttaaacatactatcattttgtgtgttgtactttaattaaaggacaaattaaagagtagtctaaaatcttacagtcagga

SEQ ID NO: 28298 - DNA, 243 bp, Homo sapiens
gcgaggtgggtggatcacctgagtcgagagtttgacaccagcctgacctacatggtgaaaccccgtctctactaaaaatacaaaattagccgggtgtggtggtgcgtgcctgtaatcccagctacctgggaggctgaggcaggagaatcgcttgaacctgggaggtggaggttgcaatgagccgggatcccgccattgtactccagccagggcagcaagagtgaaactctgtctcaaaaaaga

SEQ ID NO: 28299 - DNA, 303 bp, Homo sapiens
caccaaggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggaga

SEQ ID NO: 28300 - DNA, 391 bp, Homo sapiens
tgttaggcgagtagctgcgaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataaga

SEQ ID NO: 28301 - DNA, 307 bp, Homo sapiens
  misc_feature 10: n = A,T,C or G
gattcagggnaaaccgcaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctat

SEQ ID NO: 28302 - DNA, 418 bp, Homo sapiens
caagccggatggtacgtatattgtcatgacggtccaggagctgctgccctcctcctttgggcctgaggacctgcagaagactcagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgcccccctgccccacctttcctttccttcctgtgggccctctttcaaagtccagcctagtctggactgcttccccatcagccttcccaaggttctatcctgttccgagcaacttttctaattataaacatcacagaacat

SEQ ID NO: 28303 - DNA, 356 bp, Homo sapiens
  misc_feature 156, 167: n = A,T,C or G
gaggaccgtccctgggaacattttgccattggattgagcaaagccttcttttgctgaaaataattagagcaatttggccatactaattatcctgcagcctagtggcctctgtgtaagaggatatgtgatagagccaatctctcggtgtggactgtnaactgaccttntaaagatgttatctgtctgcccccattataaaatgggttattttgcttgatcagtgaaaagttgctacgtatgtctcttaacagagaatcagaatataggaaaaggcacttagcataatagagaccctgactgtactgtgactcttcactgagtcaccactggggagatggtcagatgctatgcttcag

SEQ ID NO: 28304 - DNA, 312 bp, Homo sapiens
ggcgctctgcggctgacggcgcttttgtctccggtgagttttgtggcgggaagcttctgcgctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagaga

SEQ ID NO: 28305 - DNA, 150 bp, Homo sapiens
atccatgtcagtgagttctgactagagctttactcccacaatccacgatagcactggattgaacgccatctggtgtgactggatcaccacttcagaagttctttaaatcgacatgttttaaatggaaaacaagggctaatacactgtggt

SEQ ID NO: 28306 - DNA, 468 bp, Homo sapiens
caactatgtggaaattgaataacctgcttgtgaatgactcctgggtaaatactgaaattaaggcatagatcaagaaattatttgaaactaataagaataaagacacaatgtaccagaatctctgggatgcagctaaagaagtgttaagacagaaattaatagcactaaatgcccacatcaaaaaagctagaaagatctcaagttaacaacatcacaactaaaatagagaaccaagaacaaaccccaaagctagcagaatacaagaaataagatcagagcagaactcaaggagacagagacacaaaaaatctttcaaaaattaacaaatccaggagctggttttttgaaaaaaattaatagactgctaactagactaataaagaagaaaagagagaagaatccaacacaatcagaaatgataaaggggatatcaccactgaccccacagaaatacaagcaaccatcaga

SEQ ID NO: 28307 - DNA, 234 bp, Homo sapiens
  misc_feature 11, 12, 34, 40, 46, 63, 67, 86: n = A,T,C or G
caccccggganntcggcattatggcccggggtgncatgtntgtgcntgtagttcctggagcangtanctctactgacgaagccatngaaacagatgatctgaccattaagctggtgatcaaggcactcctggaagtggttcatgtcaggtggcaaaaacattgaacttgctgtcatgaggcgagatcaatccctcaagattttaaatcctgaagaaattgagaagtatgttgct

SEQ ID NO: 28308 - DNA, 149 bp, Homo sapiens
attctgagtttatattataaatttagggggctgggcatggtggctcttggcagtaatcccagtagtttgggaggccatggcaggaggatcacttgaggccaagagtccaagaccagcctgtgaaacaaagcaagacccccatctctacc

SEQ ID NO: 28309 - DNA, 305 bp, Homo sapiens
  misc_feature 14, 104: n = A,T,C or G
ggtcttaacagggnaagaaataggtgggggagaaaatgtttttttctaagattttccacagatgctatagtactattgacaaactgggttagagaaggagtgtnccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttat

SEQ ID NO: 28310 - DNA, 315 bp, Homo sapiens
  misc_feature 7, 13: n = A,T,C or G
cgggaantcggtnttaggccggggatctatttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaac

SEQ ID NO: 28311 - DNA, 316 bp, Homo sapiens
ggagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcggagtgtgaagtcaaatgcatgc

SEQ ID NO: 28312 - DNA, 269 bp, Homo sapiens
cgtggtggctcatgcctgtaatcccagcactttgggaggccgaggcaggcgaatcacgaggtcagaagatcgagaccatcctggctaacatggtgaaaccctgtctctactaaaaatacaaaaaattagctgggtgtggtggcgggcgcctgtagtcccagctactcgggaggctgaggcaggagaatggcgtgaacccgggaggcggaacttgcagtgagccgagattgcgccattgcattccagcctgggcgacagcgagactccgt

SEQ ID NO: 28313 - DNA, 149 bp, Homo sapiens; identical to SEQ ID NO: 27972

SEQ ID NO: 28314 - DNA, 366 bp, Homo sapiens
ggtgaatccccagcctccaatggcccttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactact

SEQ ID NO: 28315 - DNA, 117 bp, Homo sapiens
gtagacaagaggatgcacctgcttcatggagcttgcctcctagtgagatgagacagtcagtaaataaaagacatgagcagaccatatggtgaagcagaagatgctacgtacaatggg

SEQ ID NO: 28316 - DNA, 444 bp, Homo sapiens
gaactcggtggtggccctgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaaga

SEQ ID NO: 28317 - DNA, 344 bp, Homo sapiens
atctcagattctgtctaaaggggttttttgggaagacgttttctttatcgccctgagaagatctaccccagggagaatctgagacatcttgcctacttttctttattagctttctcctcattcatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatag

SEQ ID NO: 28318 - DNA, 380 bp, Homo sapiens
gtttcttgccttgctttgccttcattactgtgtgatcttgggtcacgttctgggcctccatctcctcatctgtaaaatgaagaggttggactagattgtctggaagctccctttccacacgaagtttctctgaatccttggaccatggctgttgcattcacatcatgttcatctgctacagtgctttgtttaattacatcttagtaaattttttaagcaaattactttggtctcagaggctcacttcagtcatcctgtccttttaaaagttttgcttttccaaccacaaagacatttgggaaagcttgccctatggattacatctctaccctagctcaaaacaatttgaaataatgaaggaagactgattataatctaga

SEQ ID NO: 28319 - DNA, 321 bp, Homo sapiens
gggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtaga

SEQ ID NO: 28320 - DNA, 343 bp, Homo sapiens
  misc_feature 8: n = A,T,C or G
tctttcgnatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagag

SEQ ID NO: 28321 - DNA, 357 bp, Homo sapiens
gggcccttctgggtttttgggaaattacacaacctttctgtgcatcagttttccctttggtaacctgggggtaataatagtaataataatagataactcggtgggttactgtgacaactaaatcagacagtgtataaaaagtaaagccggctgggtacagtggctcacgccagtggtcccagcactttgggaggctgaggcgggaggatcatgaggtcaggagttcgagaccagcctggccaacatggtgaagccctgtctctactaaaaatgcaaaagattggctgggtgtggtggcatgtgcctgtagtctggctactcgggaggctgaggcgggggaatcgcttgagcccggga

SEQ ID NO: 28322 - DNA, 372 bp, Homo sapiens
  misc_feature 2, 23: n = A,T,C or G
gnacggggaaggactccactagnagggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgctta

SEQ ID NO: 28323 - DNA, 357 bp, Homo sapiens
  misc_feature 11, 25: n = A,T,C or G
attttttaatntttaaatattaatnaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattg

SEQ ID NO: 28324 - DNA, 194 bp, Homo sapiens
tacctggaactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaacc

SEQ ID NO: 28325 - DNA, 297 bp, Homo sapiens
  misc_feature 39, 186, 197, 249, 285: n = A,T,C or G
ggcagtcacagtacactcgagcacacgcgtacacccagnacatcttcgggctgctattggattgactttgaaggttctgtgtgggtcgccgtggctgcatgtttgaatcaggtggagaagcacttcaacgctggacgaagtaaagattattgttgttattttttttttctctctctctctcttaanaaaggaaaatntcccaaggactaatctgatcgggtcttccttcatcaggaacgaatgcaggantttgggaactgagctgtgcaagtgctgaaaaagganatttgtttggag

SEQ ID NO: 28326 - DNA, 298 bp, Homo sapiens
ctgcaagttatgtgtatagatattttgctactgttccacccttacgctgtgctggggagggaggtgtcactgtgagctgtgtcggtgccttaagagatatctgttgtgtcttattacttggttgcttttccccacatgtacaatgacaaaaatgccttcaacctatttgatccagccgttccagtacaactcctatacttgccatctttccaagcccaaaggtacatccagctgatggaaggagcatccttggtgttaatattcttttagtcatggtttctgaaagtaaaatgtctat

SEQ ID NO: 28327 - DNA, 233 bp, Homo sapiens
  misc_feature 14, 207, 216: n = A,T,C or G
attcctcttccttngacatcaccacgtttctctaaagtcagaaaacattccgttttggtctttttcaaaaaggtcccaaatgctgcaccctacacatgaaggccctctcacacagacgtgacgtcctgccagaaagagaatgaatgacagaaaaaaaaaagagagacaaactctaggaacaatgccgattcattccacgcagcagtnttggggggnggttcgggggaggggtg

SEQ ID NO: 28328 - DNA, 381 bp, Homo sapiens
  misc_feature 3, 19, 348: n = A,T,C or G
acnacaattatgtatattnaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaatattttaaggnattttcattatatgaaagctaccatgtgtcaga

SEQ ID NO: 28329 - DNA, 203 bp, Homo sapiens
  misc_feature 3, 10, 11, 12, 13, 14, 16, 19, 21, 22, 34, 35, 42, 47, 48,59, 69, 72, 79, 95, 106, 138: n = A,T,C or G
ccnttttttnnnnntntcnannaaaccaatggcnnttccccngggannacccaaaccantgggaagacngangtaagangtggtagggtccccanttaatggtagnaagcccactaggatgggttttccctcggtacnccattgaagggtacaaaattgtagtcatgccctctgaatcccaaagtgttttagtttgtttcagt

SEQ ID NO: 28330 - DNA, 155 bp, Homo sapiens
  misc_feature 5, 6, 33, 53: n = A,T,C or G
gaaanngttgggtatgaaaaaaagtctttcccntttttcaatgtacatagttnaacctctttctttgttacatttaaacctatatccatggatatcagtctgctttggactcctctgctagtgttacagatggaaataaaaccattaatttgaac

SEQ ID NO: 28331 - DNA, 415 bp, Homo sapiens
  misc_feature 5, 47, 48, 327: n = A,T,C or G
ggtcncttaaaaacctgtctttgtgtattaaagccaatacacaagannaaaataaggcatttttttttcaaagatctatgcacaaaaaaatttgttgcagcattatttgtgatatcaaaagtgggaaatagctgggcatggtggctcatgccctgtaatccccggcactttgggaggtgggggcggtgggatagcttgggcccaggagtttgagacccagccctaggcaacaaaatgagatcccatctctacaaaaaaataaaaaaattaaccaggtgtggtgggtgtgtgcctgtggccccagctgtgcaggaggctggggtgaanaggaacccttgagcccaggaggtcgaggctgcagtgagctatgatcgtgccactgcactccagcctggacaacaaggtgagaccctgt

SEQ ID NO: 28332 - DNA, 350 bp, Homo sapiens
  misc_feature 2, 9, 11, 20, 107, 141: n = A,T,C or G
antggagancnctgcctcantggtaaagaaatagttttggtgatgggcccggacaccgggtgggctcaccgccctattaatccccagcactttgggaagcctgaggncgggcagatcacctgaggtcaggaagttcaaganctagccccggccgacgtggcaaaacccccgccctctactaaaaatacaagggctagcagggcattggtggcaggtgccctgtagtcccagctactcgggaggcttgggcagggaagaaattgcttgaacctaggaagccagaagtttgcagtgaacccgaaggttgcactactgcgctccagcctgggcaacacagcaagactttgtcc

SEQ ID NO: 28333 - DNA, 100 bp, Homo sapiens
  misc_feature 2, 45, 85: n = A,T,C or G
ancgttccttccaaaggttccagggttgggggcctttttggggangggccccggaataaggaattttaatttaattggcctttancaaaaaggccttgcc

SEQ ID NO: 28334 - DNA, 122 bp, Homo sapiens
  misc_feature 11, 16, 27, 35, 39, 54, 59, 67, 97: n = A,T,C or G
ggccgaaaagnggccnatcctcttacntaaaaaantgcnaaaaaatttagcccnagggnggtgggtngggccattaccgcccctggtaagttccccnagccttaccttccagggaaggcctg

SEQ ID NO: 28335 - DNA, 193 bp, Homo sapiens
gtgcccagggctgcgtctgcaaaggggcatcggagaagtgcagctgctgtgcctgatgtgggaacagctcttctcccatatgtaaatagaacaacctgcacaacctggatttttttaaaaataaaacactgagccatttgctgcatttctttttatactaaatatgtgactgacaataaaaacaattttgact

SEQ ID NO: 28336 - DNA, 341 bp, Homo sapiens
  misc_feature 10, 23, 29: n = A,T,C or G
ggccgggtcntaataatttgatnatgacngtaaacctgtgttacctggttcttgtatttgctatactatactttttattgttattttggagtatacccccttctaccatttttttttaaaatttaactgtaaaacatcttcaggcaggtccttcaggggatattccagaaggcattgttatcataggagatgacagttccatgcctgtgatggcctccgaagaccttccagtcttcagagtggcacagaatgtggagatggaagacagtgatattgatgatcccaacctgtgtaggtctaggctaatgttgtattgtctgtcttagtttttaacaagaaag

SEQ ID NO: 28337 - DNA, 470 bp, Homo sapiens
agaaagggggagcattccatatagaaactgctgaaactgccacaggtgcttctccgaaaaccttacagttgtggcattgaatgttcagtatcgcttcctttctgcacacgaggcatactgttgaggtatttgttgcggtgattggttttaacgctaatctaggaattcagatagagatgctttagatttgcatgctttgcttacctaatttatgatatctacctttctatttgtaaactaacaatagctaagttgagatcagaattttaacagaaatattatttatataaaaattgttatcttttattgtcacatggcattaacaataagaaaacatcctgaaggtgatgtgacaactcggattctaaaaattatacttcaggtatttcctgatccgtggtttttcaaaattgaaacaaagtcgttctcatcagaatggcttctcctttgttctggaattgtggcactat

SEQ ID NO: 28338 - DNA, 257 bp, Homo sapiens
  misc_feature 5, 15, 29, 30, 35, 40, 54, 75, 76, 87: n = A,T,C or G
tgccntgtaatcccngcacttttgggganngcccnaggcnaggtggatcacctntgtgggttggcagtttgagannagccctgaccnacaccggagaaacccgcatttctataaaaatacaaaaattagcctgggtgtggtggtgcatgccctgtaatcccagctactcaggaggctgaggcaggagaactgcttgaactcgggaggcagaggttgcagtgagccaagatcgtgccatcgcacccccagccctgggt

SEQ ID NO: 28339 - DNA, 219 bp, Homo sapiens
  misc_feature 21, 41: n = A,T,C or G
cttcctttgtttcccaaaganattttcagtatatgaatgantacccttttgaaggaaaggaatatagaaggttcagtgtatgacgatatcttttgaaggaaaggaatgtatctcttggtcccatcaaattttttcttgacttacaaaattgttgatataagtttgtctctgtgtccccacccaaatctcatcttgaatagtaatccctatgtgttgagg

SEQ ID NO: 28340 - DNA, 471 bp, Homo sapiens
  misc_feature 20, 27, 58: n = A,T,C or G
aggtgccgtctgctttcaangggaaanagtcccgcccatttctggcaacctttccctntcccctgagccccactgctgttattatcactaactgaaattctaccccattccccaaaactacctcacctctaaaaagacttttctgtcctcatcagagggatctctgcccatagacagaactcccagagctccttgcagctgtcactagtggcactaaatgcacacacttgtcatgtgttatagtcctctggaggtcttatttctgttgccatatatttgatgagttgaagagaggcttaattccaactaggtatttagtaaacatctactgaatataaatacaagtataaatctaaatataaatatcttgcttttttgttcacttttaagaagacaaccaggctgggtgccagtggctcacgcctgtaattctagcactttgagaggcaaaggcaggtggatcacctgaga

SEQ ID NO: 28341 - DNA, 268 bp, Homo sapiens
  misc_feature 4, 14, 34, 36, 39, 40, 57, 59, 90: n = A,T,C or G
cgcngtgggaagangttgccctttcctccgaganangannaggtttcctgttaagancncccaagtagcctgtgcctttaattagagccngaccaagcctttcaaggtccctttaagtatttgatgatcaacctgaacacgtttctattcaaggagaaaacacccattcagtaagaagatggagtagatatcagataaaacaattcacgtttaatatgtaaatgtaccaattatgtggattcagtttcaactttcaagtaccttcctg

SEQ ID NO: 28342 - DNA, 115 bp, Homo sapiens
  misc_feature 52, 88: n = A,T,C or G
ggaataggaaaacccctgcctttaccatttttaaacccaaggcctttcttantttattgccccttttttttcttaaaccaccaagganctttttcctttccaccttggtcctttt

SEQ ID NO: 28343 - DNA, 196 bp, Homo sapiens
  misc_feature 15, 16, 29, 35, 45, 51, 65, 69, 81, 95, 100: n = A,T,C or G
tgggcccgggaaatnnaagtgcaactgcnagcccntgaaactccnggcccntcaaagcaaatcantccngtcttcaagccnttctgagtaagccnggganctaccagggtggtgtgacaccatgcccccgttctaaatttcttaaatatttgggtttgaccagtagttctgatggaaatagtaggatgtaccctgc

SEQ ID NO: 28344 - DNA, 498 bp, Homo sapiens
  misc_feature 2, 13, 269, 317, 469, 498: n = A,T,C or G
antggcctttcantctcttcttcagaaaccaaagctgcagatccaggctttttctgggaaagtgaggccacccatggctctggagaagtctcttgtccggctccttctgcttgtcctgatactgctggtgctgggcctgggtccagcccttccctgggcaaggaatcccgggcccaagaaattccagcggcagcatatggactcagacagttcccccagcagcagctccacctactgtaaccaaatgatgaggcgccggaatatgacanggggggcggtgcaaaccagtgaacacctttgtgcacgagcccctggtnagatgtccagaatgtctgtttccaggaaaaaggtcacctgcaagaacgggcagggcaactgctacaagagcaactccagcatgcacatcacagactgccgcctgacaaacggctccaggtaccccaactgtgcataccggaccagcccgaangagagacacatcattgtggcctgtgaaan

SEQ ID NO: 28345 - DNA, 200 bp, Homo sapiens
  misc_feature 20, 21, 40, 53: n = A,T,C or G
taggttaattttttttcccnntgttcatttaaaaaattantcctgaaaaaccnttttagaaacctgcaccatacctcccattgatgttccacccagtaaattgtgtcctgtattacctcctgttgctgtattgtgtctgtgttacctctgttcatgtgcatagtttttgtacatttacctgtaataaaatgatgaaaaac

SEQ ID NO: 28346 - DNA, 405 bp, Homo sapiens
  misc_feature 3, 24, 27, 32, 50, 60, 62, 82, 83, 94: n = A,T,C or G
ctncccctggggaatctccggccnttntattnggcccggggtcttcttcntttcgcttcngngcccccgtgggccgcccgannaggatggggcnaagtgtcgtggacttcgtacctgctaggaagcctccgtagtcacccgacgagacccagaagtggcatgataaacagtataagaaagctcatttgggcacagcccctaaaggcccaaccccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgaatgaagttcctggttgc

SEQ ID NO: 28347 - DNA, 208 bp, Homo sapiens
  misc_feature 2, 41: n = A,T,C or G
cnagcaccgcagcaatgcagctcaaaagcttagcctagccncaccccccacgggaaacagcagtgattaaccctttagcaataaacgaaagtttaactaagctatactaaccccagggttggtcaatttcgtgccagccaccgcggtcacacgattaacccaagtcaatagaagccggcgtaaagagtgttttagatcaccccctccc

SEQ ID NO: 28348 - DNA, 373 bp, Homo sapiens
  misc_feature 2: n = A,T,C or G
tntatggcccggggattcatggaattgttgcccttttcagtggttaactgttagattttataatcagaagattgagatctttaaaggacaaaatggaaaatgaaattaggtttggggtaaggaatcctacttggacactacaaaaatagaaggaaaaaaaggtgaatgaataattggcaaaacaaactctttttcctgtaagttcccttttcccaaattcttgccatcatgctaaaaaaagttgtctcgtgggttgatttttctcagaatcctgatgcttgttgttaataagaatttttttcatgtgccaaagttttgtttttcgtgtgacttctgcggcaattttggtcttactgaaaatatttttttaagt

SEQ ID NO: 28349 - DNA, 451 bp, Homo sapiens
  misc_feature 3, 10, 15, 24, 31, 427: n = A,T,C or G
ganatctacnagatnccgggagancgcggancgggttgtgccctggaggtggaggggaagatggtcagtaggacagaaggtaacattgatgactcgctcattggtggaaatgcctccgctgaaggccccgagggcgaaggtacccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttactaatttcaaaaactaccagttctttattggtgaaaacatgaatccagatggcattggttgctctattggactaccggagggattgggngtgaccccatatatgattttcttt

SEQ ID NO: 28350 - DNA, 277 bp, Homo sapiens
  misc_feature 13, 23, 33, 43, 91: n = A,T,C or G
tcggccatttttnggccgggaantaaagaaatntttaaaaccncaaaactcactgtgtttgtagggggaggtgtgatttacagagtaaccncatagtaattataattattagaatgtccagttttcaaaaaacgttacaaggcatacaaagaatgggaaagtgtggctcattcaaaggaacaaaataaagtgacagaaaatatccctaaagaaacccagacatcaaacttaccagacaaagactttaaaacaactgtcttcattatactcaaatgac

SEQ ID NO: 28351 - DNA, 273 bp, Homo sapiens
  misc_feature 1, 6, 10, 13, 20, 33, 36, 46: n = A,T,C or G
naagangtcntantatcccnggatgggtagaanacnagaacctccngggccagccccctgggactttgcctagcccccaaagaaagggagggatgtgggttaaatcctgtttcaccctgggtttgtccctaaggccatagttaaaaagtaccagcctctggctggggtcccgtgaagcccaggccaggcagcccaaatcttgcctgtgctgggcatacaacccctctgctttcacatctctgagcctatatcctcattaggaaaggtgggctt

SEQ ID NO: 28352 - DNA, 359 bp, Homo sapiens
  misc_feature 287: n = A,T,C or G
gttttaatgctaattgacttacctaattaaacatacacacaaatttaattatttttttctctttaacctgatcacgacacagctcttaatcattgtcactttcagtatatcatagtagttagtagtagattgccttgatggcagtaattctgtagtaatttctattcaatcaaacctaagagagctttgatcttactgtaaaggtacaaacaaatctcttatataattcctagctttttttttgtttatgattctgatcaactataagacacaatgtaaagaattgnggcttataatttatctgaaatttattagcttagtttagtttgggcagggagttacaaacttaataggaattg

SEQ ID NO: 28353 - DNA, 403 bp, Homo sapiens
  misc_feature 7, 13, 43, 52, 55, 317: n = A,T,C or G
tcggccntttttnggcccggggggccgcttgtgccgccgtgcnccaaaagantgnctgagggggccgggggcgctgcggcaccagctggtttgagccacctgaactggaaaccaagatgccaggacccccaaccgccagaccacctgaatggaatgacatcttacgcaaaaagggtatcttacccccccaaggaaagtctgaaagaattggaagaggaggcagaagaggagcagcgcatcctccagcagtcagtggtgaaaacatatgaagatatgactttggaagagctggaggatcatgaagacgagtttaatgnaggaggatgaacgtgctattgaaatgtacagacggcggagacctggctgagtggaaagcaactaaactgaagaataatttgggagg

SEQ ID NO: 28354 - DNA, 500 bp, Homo sapiens
  misc_feature 14, 22, 39: n = A,T,C or G
ctccaggggaaatntccggccnatttatggcccgggaancccggcccgttgtgccccatgtacccctaaaacttaaaatataataataataaaaaaataaaaaataaaaaataaagtatagcaaagaaaagaaaagttaaaattctggaagtgaaatttgaatcaaaggtaaaaggtgttatagaagaaatctgtgtgtgaatatgttgacactgctaccatttaaggctctacatatgttgcctgatgaacttagtgaaggcaaaattatttaggtaaatgaggaaaggggttgtgaggctctgtgtcccagagaatgtgacaatgccaacaaaaacaacaacaacaaaacacatttcacattaaagaaccttttagagttatttctcaagattgaaagcacaaagaataaaatgttgggaaggttgatcaaacttaaaaaggagaatgctctattgtaattcataagacaaatgcagaagaaaagcactgctccaact

SEQ ID NO: 28355 - DNA, 471 bp, Homo sapiens
  misc_feature 3: n = A,T,C or G
gancttgaagaaagattgtccccaggcaccagtatctgaatcctggggattatgattcaccctctttggagaacgtgctctcttttcaccccccacctcctgagagccactaatgtaagatacagaaacatagctgaggaacaaatagaccatttccatactaaaccagtttgttaactttagattttttccaatagtgtgagtatgtccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctc

SEQ ID NO: 28356 - DNA, 219 bp, Homo sapiens
  misc_feature 5, 15, 29, 30, 38, 76: n = A,T,C or G
aggantttccgagancaagccctggcaanntggtgaanacccctgtctctcccaaagtgcaaaaattagccgggancatggttgtacattgccctgtagtcccagctacctctggaggctgaggcaccaagaatcgcttgaacccaggaggtggagttgcagtgagctgagatcacacccattgcacctcctgcctggggaatggagtgagactccatc

SEQ ID NO: 28357 - DNA, 219 bp, Homo sapiens
  misc_feature 2, 30, 40, 43: n = A,T,C or G
cngttgctgttccgaaaagcatcttgagangaacagaaanganaaggatgcctaaattcccgtctgattctaatagagagcccggattcacccgtttggctcgatattataagaccaagcgagtcctccctcccaattggaaatatgaatcatctacagcctctgccctggtcgcataaatttgtctgtgtactcaagcaataaaatgattgtttaacc

SEQ ID NO: 28358 - DNA, 206 bp, Homo sapiens
  misc_feature 6, 38, 59, 79: n = A,T,C or G
gtcctnaatggatctagaaacttcatcgcccctctgancgcccgatcaccctctgagancccaccttgctcattaaacnaaatgccccatgttggtccctctgccctggacctgtgacattctggactatttctgtgtttatttgtggcccgagtgtaacaacccatataataaatcacctcttccgctgttttagctgaagaatt

SEQ ID NO: 28359 - DNA, 470 bp, Homo sapiens
agccgcagggcaaacactttctacattggctttcctcacttgtgccctttttcctgatctagaatgttgggcttctctggcagaagcagaaataaataattgagaaaaagcttattatcagatgaacacattatgcattgatttgttcctgcatgtgtattctcataagttaggtttaattaaatgtacaatatagtggaaggattaagtgaaatatgggatagcaactgggcaggatattaggaggtcacggacattagtaaatcggaagactgagtagctacacagaaagcattcacaaaatgatactgagtaaagcctagcactgaactgtagtaatagtaatactacaatcctaacatgagtcatacacgtttccgtcattataattgttacttcccaaaataattgttatctgtctgctgtatattatccacctcccctaattgcaacgtgtgtaaatgggaact

SEQ ID NO: 28360 - DNA, 120 bp, Homo sapiens
  misc_feature 4, 25, 26: n = A,T,C or G
tgangtcccaatcccctgccgtganntttgggggggtgaaagagtgggttgtgaaggtgggccccccatgttaaccccctccactctttctttcaataaaacgccagttgcaaaccaccc

SEQ ID NO: 28361 - DNA, 341 bp, Homo sapiens
ggtgtctatttgattcttctctcttttcttctttattagtcttgctagtggtctatcaattttgttgatcttttaaaaaaaccagctcctgaattcactgatttttttgaagggctttttgtgtgtgtgtctctatctccttcagttctgctctgatcttagttatttcttgccttctgctagcttttgaatgtgtttgctcttgcttctctagttgttttaattgtgatgttagggtgtcaattttagatctcttctgctttctcttgtgggcatttagtcctataaatttccctctacacactgctttacatgcgtcccagagattctgttatgttgtg

SEQ ID NO: 28362 - DNA, 379 bp, Homo sapiens
  misc_feature 13, 14, 64: n = A,T,C or G
cttggtgccaaanngatgaagttgccaccattgttgaagccagaggccaatgaaattaccgaanggccagtcccaattaaagtaaccactggcaacctttgaaaatgtctgtaccagcccaacggtttccccttgggggctttgaaataacacccaccagtggtcttaaggttgaagtgtggttcagggccagtgcatattagtggacagcacttagtagctgtgggaggaagatgcagagtcagaagatgaagaggagggaggatgtgaaactcttaagtatatctggaaagcggtctgcccctggaggtggtagcaaggttccacagaaaaaagtaaaacttgctgctgatgaagatgatgacgatgatgatgaaga

SEQ ID NO: 28363 - DNA, 492 bp, Homo sapiens
  misc_feature 21, 37, 40, 42, 44, 46, 47, 49, 65, 102, 433, 491: n = A,T,C or G
tcttgcttacccccttttaangggcccccgggccccnagnantnannangtttgggcttggtgancaaccaccttggtgggtggccgccattgggtcctccnagtgggaaaaacaccgtaaaatccgtggtgacctttttgagtattcgtcagcctggagccccgtaccgaagcctggaaaaccccaaatggaaacagtatcggggaattctgtttgtctggtctttgaataacccaaccccagtgatttacatgcctgatagctaagtgagtttttaatggccattgtgtatggattttgatgcacaactagttaaaagcctttcataccagtcagtattcccagccttgagcgcacgcgcgcacacacacacacacatacacacacgcattaatttttgtactttgcttcttttattgttttgtaatctgnaaaatgaacacatggcagaaaataacccctgattggtaggatcatagttctaaatggna

SEQ ID NO: 28364 - DNA, 264 bp, Homo sapiens
  misc_feature 1, 18, 26, 27, 29, 42, 45: n = A,T,C or G
nggccggggggccggatnaccctganntnaggagttcggganccngccctggcaaacacccccatctctactaagccgaaaacccatctctactaaaattacaaaaattagctgggcatgattgcgcatgcctgtaatcccagctactttggaggctgaggtggggagaattgcttgaacctgggaggtggaggttgcagtgagcccaaggtcgcgacactgcactccagccctgggtgacagagtgagactccatcccaacag

SEQ ID NO: 28365 - DNA, 435 bp, Homo sapiens
  misc_feature 3, 15, 30, 402: n = A,T,C or G
atngcccggggggcnaggaccatattggcntttacctctactaataaaagagtacctatctacctcagtgtcatttactgttactgtagtaattaatgcctttggaagaatcttttgaaatagttctcaaattggtaccactacttggtttggaattatttttttttcttttcataatcaatggttatataaatgtatattgtcctagtcagtattttatatatgctaaggactcactagctggcttggcactaatacctcaataaaaggaatacttcttttggaatcatgaaacaaaagtgaataaacctccaagttatttttccaaccaaccttctttgaaaaatcttggatgagtcactcaaatcaagacatgttataaaattatctgtaatttttggnagaacatatacattgttctaataaataattttc

SEQ ID NO: 28366 - DNA, 390 bp, Homo sapiens
  misc_feature 3, 4: n = A,T,C or G
atnntgtgaaaaatttcttttgcctttttcacctcttcttcttggacctctagttacacatatgttgaataatatattgtcccacagtttttagatgcctctgtttctttcatcccttttctgttaacattttagctttgataatttctgatttttatgtttgctgattccttagctgtatccaatatattgataggctcatagaaagaatttttaaactctgataatcattaaaaaacaattctgtcgttatttgacttttttttgatagtattcattttttctgttgaaattctccatctctccatgcatgctgtccactttttcattagatcctttaacttaatcccagttaaaaagtcctatcttgaggagtgcttgatctggggg

SEQ ID NO: 28367 - DNA, 213 bp, Homo sapiens
  misc_feature 4, 9, 40, 45, 46, 52: n = A,T,C or G
aganctganagtgcccctctcagcactttaagtggtttcnaagannaaaccnttgggaaagagccttgatacccatttgacccaaggagaaatggttagttgagtgcccccaggtcaggatggggacccctgggtgtgtgtgggggggaatgtgtgtgtatgtcaagatttcttgaattcagcaccaactgattaatattcttctagaaattc

SEQ ID NO: 28368 - DNA, 356 bp, Homo sapiens
  misc_feature 18, 19: n = A,T,C or G
tctgtagtttctcagaanngcctatggattagtttgaacctgtcaaatccttgcataccttctgtgacaccccctgccccattttctgtctttaattaacccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaatac

SEQ ID NO: 28369 - DNA, 438 bp, Homo sapiens
  misc_feature 3, 6, 330: n = A,T,C or G
tantanttttaaattgacatatatattgtaaatttaacattctgcagcaccagaaggtttgggtggcattttggtggcaaaaagcagagtttcagccccactggaaaatgatgggaaatgagagttgagtgacacccgtttaactgagaaacctctttggaggttttatggtataatagtttaggcggactaaaggaaagatgaaacattcacctttctcctggtaaaaggccagcaaaggaactatgggacgatccattatttgcagttttccagaagcagcatttcctcatctatatatttatccaaattatgtatagggggggaggngaatttccagacctgaactgatactcagtttgtgacactatgaacgtttagctttaattaagacccacatgtttgtccctaatcctttattaaaatgacagcagtatt

SEQ ID NO: 28370 - DNA, 164 bp, Homo sapiens
  misc_feature 9, 16, 27, 28, 36, 41, 42, 50, 70, 75, 78: n = A,T,C or G
ctccggccntttattnggcccgggaannacctgaanctgannaattaacnagccccaatatctacaatcnacccnacnaagtcattattacccctcactgtcaaccccaaccacaggcatgcctcataaggaaaggttaaaaaaagtaaaaggaacctcggtga

SEQ ID NO: 28371 - DNA, 339 bp, Homo sapiens
  misc_feature 3, 11, 71: n = A,T,C or G
tcntgggggantgggagccccaagggcctgtttctgccaccttgctctcctcagagttggcttttgaaccnaagtgccctggaccaggtcagggccctacagctgtgttgtccagtacaggagcccacgagcccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaagggatgggggggtgtgctacacagtggtatgtcact

SEQ ID NO: 28372 - DNA, 464 bp, Homo sapiens
  misc_feature 2, 20, 75: n = A,T,C or G
cncccccgggaattcggccnttatggcccgggagttgcgcctatcttgattttacagaatctgtcttaagtaccnattttggtttttcaaatcaatgtttctgaaatttttgaacactgaaagtggttttaaatgaatattctgaatctagttctttagaatcctctttgaattgtgaaatgcaaaataattgttagcagtttaacctgaaagatctttttacatgataaatgggggaggagaaagactgaaatgaaaatgttgaagaccctgatttgaaattgagtgtaaaggtctagatcctgtaagttttagagtagctttagagacaaagctagtatcccacttggtgagatcaagtaccttgtggtttaaaatttaaagtaacccagtggccattttaacttcactaatttctcttggaggagctaatttttaattgctcatgattgtaaaacatactt

SEQ ID NO: 28373 - DNA, 418 bp, Homo sapiens
  misc_feature 50, 61, 344: n = A,T,C or G
atagtagcactcaaatatttgttgaatgaattataaaaatgactacttgnattgttaattntgtgtattctagtgaattaaatctcttcggcatcatttactcccttaggtatttgactttgtgtcaaatgttttggcaaggataaaattataacagactttcttgaacaaccaaaatgtaatctattaaggattttccttcacttttgataaaataagaaaaaaggaatttaaaaccttgcatcctaatgtaaaatagaattatatggtgtttaatatcagtgtccctttagctattatattaaactactatagttaataaattttatcattattttgatgtnaggtttttaacaatttcataaagctataaaaagatacttggtcagataaagtttcctctgcttttaattttaat

SEQ ID NO: 28374 - DNA, 371 bp, Homo sapiens
aatctcagtcactctaggactctgcactgaatggctgacctgacctgatgtccattcattcccacccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaga

SEQ ID NO: 28375 - DNA, 441 bp, Homo sapiens
  misc_feature 4, 11: n = A,T,C or G
accnaataccncatgttctcacttataagtagaagctaaacattgagtacacatggatacaaagaagggaacccgcagacactggggccctaccctgaggtcggagcatggaaggagggtgaggatcaaaaaactacctatctggtactatgctttttatctggatgatgaaataatctgtacaacaaaccctggtgacatgcaatttacctatatagcaagcctacacatgtgcccctgaacctaaaaaaaaagttaaaagaaaaacgtttggattattttccctctttcgaacaaagacattggtttgcccaaggactacaaataaaccaacgggaaaaaagaaaggttccagttttgtctgaaaattctgattaagcctctgggccctacagcctggagaacctggagaatcctacacccacagaacccggctttgtc

SEQ ID NO: 28376 - DNA, 477 bp, Homo sapiens
  misc_feature 4, 15: n = A,T,C or G
tatngccgggcattnaaaatcgatggcaaggtcccgaactgatataaccctacccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttagagactggcaagattactgatttcatcaagttcgacactggtaaccctgtgtatggtacctgggaggtgctaacctaggaagaattgggggtgatcaccaacagagagaggcaccctggatcttttgaccgtggttcacgtgaaagatgccaatggcaacagctttgccactcgact

SEQ ID NO: 28377 - DNA, 471 bp, Homo sapiens
cacggttgaatcctgcctcccccagaaaagtagcctagagtaagtcatctttctgagcctcaacttccttgtctataaagtgaggcaaataaattatacttacctcacacttgtaactacaaataaaatctgaacaaagtactttttggaatgccttgcacttagcaactgattaaaaacaaatcactctcactgctgttctcattgccatcattaccttcagaatattttgaagttttagggcattcgtaggtaccctctcccaaattccacccttatcccggatttcctagcctcattgaaaacaaggtcaacagaagtgtggcttattgaagggggggtgggagagaagaaagatagggttgggacaataggactagcagaaagaaaagctcttaatcaacagttcctgttttataagtaattgcccctctaccatgggaggtcaaatagtacttcagcatcattaga

SEQ ID NO: 28378 - DNA, 228 bp, Homo sapiens
ccgccctgggtgccagaagcccccaatttccctaccttcatgggatgtgaaaatgccccaggatgcctataaaatcacccacggtctttagcccatgccacaaacggtagttttgtgtgttggctgctccactgtcctctgccagcctacaggaggaaaagcaaggcttacagaaggatgttccttcaggaggaagcagcactaaaagcactctgagtcaagatgagt

SEQ ID NO: 28379 - DNA, 393 bp, Homo sapiens
  misc_feature 11, 14, 33, 51, 344: n = A,T,C or G
gtcggcaattnatnggccggggtcctaatattnaggttgaacgaacggaanatgtatttcaattttctatgaaaactgttatactttctgctgagtgccctgggccctgacggtctgtgtgctggcccgtggcctttgccgcccaccactattcgcagctcacacagtttaccctgtgagaccacactcgactcttgccagtgcaaactgccctcctcggagcccgctcagcaggacctttgtttaccgggatgtgacggactgtacccagcgtcactggcactttcaaactgttcttactcatccagatgattcttaatttggtctgcggccttgtgtgcttngttggcctgctttgtgaatgtgggaaacataggtaccaggtcttctatg

SEQ ID NO: 28380 - DNA, 451 bp, Homo sapiens
  misc_feature 422: n = A,T,C or G
gatatattggtggattcttgtcctagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaatcttctagaaaactccaagataaaagggagnagttttctctaaattgaaacaactgaaga

SEQ ID NO: 28381 - DNA, 210 bp, Homo sapiens
  misc_feature 11, 16, 21, 40: n = A,T,C or G
tcatttaatcnagaancgaanagtcggagggttcgaagancgatcagatacccgtccgtagttccgaccataaacgatgcccgacccggcgatgcggcggcgttattcccatgacccgccgggcagcttccgggaaaccaaagtctttgggttccggggggagtatggttgcaaagctgaaacatctaaataaataatgacatgcattta

SEQ ID NO: 28382 - DNA, 136 bp, Homo sapiens
  misc_feature 8, 9, 53, 76: n = A,T,C or G
ctagagtnncctggaaaacctaaaaaaagtaaccgggcccttttgcctgactnaggggagatgatttccccaaganggaagaaaacctggaaccctgagaaataagtgatttagtaatgtggctgctaaaatacgg

SEQ ID NO: 28383 - DNA, 342 bp, Homo sapiens
  misc_feature 15, 57: n = A,T,C or G
tccggccaattaatnggcccgggggggtaatgggccttttagttgaatacccttccntctgttgattttctttttacccactttgctggtatttccccagtcttatttgtagttctttctttcctgtatctcttcttcatgtattggtattactcaattttttttgtttttgtttctttttacggggtttcgccatgtcgcccaggctgagtgcagtggcgtaatcgctcgctgcggcctcgacctcttgggctcgagcaatcctcctgccgcggcctcccaagtcccaagtgcttgggactccaggagcatgccaccatgcctgactaatttttatttttt

SEQ ID NO: 28384 - DNA, 473 bp, Homo sapiens
ggctgtagtggcttcgtcttcggtttttctcttccttcgctaacgcctcccggctctcgtcagcctcccgccggccgtctccttaacaccgaacactatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaata

SEQ ID NO: 28385 - DNA, 214 bp, Homo sapiens
tgatcaaatatcactctcctactcacaggactcaacatactagtcacagccctatactccctctacatatttaccacaacacaatggggctcactcacccaccacattaacaacataaaaccctcattcacacgagaaaacaccctcatgttcatacacctatcccccattctcctcctatccctcaaccccgacatcattaccgggttttccg

SEQ ID NO: 28386 - DNA, 213 bp, Homo sapiens
gaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcgc

SEQ ID NO: 28387 - DNA, 312 bp, Homo sapiens
gacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctga

SEQ ID NO: 28388 - DNA, 298 bp, Homo sapiens
  misc_feature 24: n = A,T,C or G
atggacgttaatatcgccccactncgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacga

SEQ ID NO: 28389 - DNA, 341 bp, Homo sapiens
  misc_feature 28: n = A,T,C or G
tatggcccggggggctcccatcccgggnaagccggtggggccttcggaaaagagagagcaggctgaagaggaacgatatttccgagcacagagtagagaacaactggcagctttgaaaaaacaccatgaagaagaaatcgttcatcataagaaggaaattgagcgtctgcagaaagaaattgagcgccataagcagaagatcaaaatgctaaaacatgatgattaagtgcacaccgtgtgccatagaatggcacatgtcgttgcccacttctgtgtagacatggttctggtttaactaatatttgtctgtgtgctactaacagattataataaattgtcat

SEQ ID NO: 28390 - DNA, 344 bp, Homo sapiens
  misc_feature 12, 31: n = A,T,C or G
gaaacctatttncaatatcaaacatttatcnggataaaaacatttagcaagttataaataggaattactatgacttgatatgaacatctacaaaaaaactgtagctaatatcatacttattggtccaagactaaatgctttcctcctaagtccgagaacaaggcaaggatgtctttaatactactcttattcaatagagtactggcgctctagctactgcagtaagctaagaaaaaaaaaggcacacagattggaaaggaaggaataaaactataattttttgaagatgacatgattatcttaataaaaatcccaaggaatctaaagaaaaagaatcctagaac

SEQ ID NO: 28391 - DNA, 357 bp, Homo sapiens
  misc_feature 10, 31: n = A,T,C or G
ggatccgagnaacgctctaagcctgtccacnagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtga

SEQ ID NO: 28392 - DNA, 302 bp, Homo sapiens
ataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 28393 - DNA, 170 bp, Homo sapiens
  misc_feature 32: n = A,T,C or G
agggaaacccaggaaaatgtaagtgattcacnacagtgtgctattggtgtttccttgggaccatgatgttgttcagtgctaggtgaaagcctgagaagaacagatgagagacgctgtttagagtgacagacatgtagtaagtggctgcctttgattgtaggatttcaaga

SEQ ID NO: 28394 - DNA, 310 bp, Homo sapiens
ggagcccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatggg

SEQ ID NO: 28395 - DNA, 257 bp, Homo sapiens
  misc_feature 5, 7, 33, 58: n = A,T,C or G
gagtnanagagcaaatgtccaaggaagggcttnagagaagggctccagcaagaatgcnaaggaagatttgtctaaaatggcttttcaaggcggtcatgagcttgcctctaacccagcaaagcgtgtggaagaaacatcggcagtgagggctcccatctctcatttctcaaagagccgagactttcagcgaggccacttgccattcctggtaggtaatcagatcgctgttaattaataaagctgtcaggtggctcgtc

SEQ ID NO: 28396 - DNA, 363 bp, Homo sapiens
  misc_feature 31: n = A,T,C or G
gcgactctctatgcggaacaccacagtgatntcacattttgcgagattatcctgatggagatggagtcccatgatgcagcctggcctttcctagagcctgtgaacccacatttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaaggga

SEQ ID NO: 28397 - DNA, 169 bp, Homo sapiens
  misc_feature 15, 19, 41, 60, 65, 100, 125, 148, 156, 159: n = A,T,C or G
atgaccctgacactnccantttctgtgcccagggtttgggntttaaattattgactttgnacagnctgcttgtgggctctgaaagctggggtggggccanagcctgagcgtttaatttattcagnacctgtgtttgtgtgaatgcggngggtgcangcntcccagaatg

SEQ ID NO: 28398 - DNA, 335 bp, Homo sapiens
  misc_feature 30, 32: n = A,T,C or G
gctctctcgcgcgcggtgtggtggcagcantncgcagtccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcat

SEQ ID NO: 28399 - DNA, 322 bp, Homo sapiens
  misc_feature 2, 44, 45: n = A,T,C or G
anggcccgggggcccccccgccaggcctcccgaagcggcccttnnttgcgatcaaagttctacgtgcgagagcccgccgaatgccaaacctgactggctgaaagttgggttcaccttgggcaccactgtcttcttgtggatctatctcatcaaacaacacaatgaagatattttagagtacaaaagaagaaatgggctggaataaactttcgaaacactaatgtagtatgctccgtatagtgattgtagctgttcctctggattcaccatctgttgagttgtaaatgtgagagaaaaagttatatgtgaatatatatcaagc

SEQ ID NO: 28400 - DNA, 427 bp, Homo sapiens
  misc_feature 6, 9, 21: n = A,T,C or G
aatagnccngttgattttttntatgtcttctttttgtgttttattagattgcctttccttaaagttttttgactgttcatttttcttaaaaatgtgtaaccattaacatatagtttattagtagttagattaggttagaaaatttaatggatgaaaatacgtgttttattaatcttgtctatgttcaattccaactctaaatattagtattgtaacatgaacataatttttttaacattaaaatctcaaattctctcatttatacatccacatgttctcagggtttattggctttgaaatcaatagtacaatacatcttcattcttgtttcccactctatccctgagaatgtgttgatcacccagctagtgagaccactggccccggggagctcagaagtctaccagccacagtggaaatgagcaga

SEQ ID NO: 28401 - DNA, 381 bp, Homo sapiens
  misc_feature 19, 30, 366: n = A,T,C or G
gcaggctagagaatggccncatgagcagtnaggacctcccccgagatgaggatccccagaacatagtgtgggatgcaggtctggcctctgcataccctcggcttcctccatcacttattctcagacatctaaaccactaacatccagactggggatcccaggagggtctacagtgtcaagagagggcaagtccacttcaggatcaaccttcctgtggccccttactttccttggtccacctttccaggtcacccatccagaccgtcaccagggatcactgccctgggcaccaacccaatgcggggacaagtagaaaaagagctctggggaaaataccaaagggaatagtcactcaattttattggngatgataaactcctg

SEQ ID NO: 28402 - DNA, 109 bp, Homo sapiens
  misc_feature 4, 46: n = A,T,C or G
agantttcacatttaaaataagccaaaagcctgatgttcacattgngcttttaaactccgtaacagctgaatacaacataacatagtctcccttgaaattccctccctt

SEQ ID NO: 28403 - DNA, 350 bp, Homo sapiens
  misc_feature 5, 214: n = A,T,C or G
gatcnctatggatatgacttctgaatggctctccagaatttcaatcttcattacttctagcatagtaaaactaaatttctcattattccccccaaactgctgtcacttcttatattcctatttctgctattctctgagatactctctgatccttgtctgtgttgaattttctttctctctgatgtctactccatagactgccagaaaaacctgntgatcaaacaaagctgtttattagcttattacagtaagagaaaacccactttgactgtgtcttagtaatatctcacaagggagaagtcaggagaggatattcataaagttttaggacctgggctaggtgattttga

SEQ ID NO: 28404 - DNA, 207 bp, Homo sapiens
  misc_feature 6, 9, 32, 146: n = A,T,C or G
gaaganccnttaagtaattttaaaaaacactnttgcttttcccaatcctaccaagtaaaggatgctagataaaagaaatcccaagtcgggccgggtacagtggctcacacctgtagttccaacagtttgagaggctgagatgggantatgttttggggccatgagtttgagggcagcctgggcaacacggcaagacctcctctctac

SEQ ID NO: 28405 - DNA, 172 bp, Homo sapiens
catatccattaaaaatatttaaaaattagccagacatggtggcacgcgtctgtggtcctagctcctcgggaggctgaggcaggagaatcgcttgaactcgggaggcagaggttgtcatgagctgagctaacaccacggcacttcagcctgggtgacagaatgagactctgtg

SEQ ID NO: 28406 - DNA, 420 bp, Homo sapiens
caaaggcacatttgatactaatgtgtctccaggtgactttagtaatacgattagcgtttcagctatgctcttcttgttaacattttcaacttgtatcaaatttttcctttttaaaggaaacagctatcagcaaacagctaggggatgtccagtggaaaatttagaactgcactggagaaagtgtagtttcaaaaccaaagaacatagtgatataatgcattgaataaagtgagggttcaagtactcattttagagcctgccaagaccaaataattttaccccagtcagaaacaaggccagaaaaagagatgttttagggaataccattccaccctcaaacatttacctacaagggatatatcaagggacatgccaagaagaaataatagttacagacattttggaaatacctgcaacaga

SEQ ID NO: 28407 - DNA, 214 bp, Homo sapiens
ctagcacattttgtgttgattaatagattaaagtgatacctgtcataacagtttttcagggttgtccaagcagagaatatggatgacaacaggctgcccaaacagctgttacaggatgaggttaagtgcagtgaccacaggaggtttatacaaactacctcagaaaatggagcacagccacagaatcctgggctctctccacgtctggcagatt

SEQ ID NO: 28408 - DNA, 139 bp, Homo sapiens
  misc_feature 7: n = A,T,C or G
ggttgcncagtagtgctagcggcttcgcggttcggtcctcgcacccggcagccgccactggtgctgagctgctaggaagcccctatcgccgagctcgttggagcttgaacccattgtcacccctccgactcaccggccc

SEQ ID NO: 28409 - DNA, 318 bp, Homo sapiens
  misc_feature 180: n = A,T,C or G
ctcactgcaacctctgcctcctgggttcaagcgattctcctgcctcagcctcccgagtagctgggattacagcctactcaatgtgaagatgaggatgaagattttgtgatgacccacctttttttaaataaatgagaaagaggaagaatttcatgtttgccagaagataggcccagaatngaagaaatatttgaatgtctttggttacaacttcccaccagaacacaatgaagatgtttcttgacccaggtgtttcttgggagccaagataaatcataacattcccatggacttgccatttcagttaccttgaacaga

SEQ ID NO: 28410 - DNA, 239 bp, Homo sapiens
aggccgaggcgggcggatcacctgaggttgggagtttgagaccaggctgaccaacatgaagaaaccccatctctagtaaaaatacaaaattagctgggcatggtggcacatgcttgtaatcgcagctactcgggaggctgaggcaggagagtctcttgaacctgggaggcggaggttgcggtgagccgagatcacactgttgcactccagcctgggtgaaaagagggaaacttcatcac

SEQ ID NO: 28411 - DNA, 300 bp, Homo sapiens
  misc_feature 180: n = A,T,C or G
acatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggnttctgagtcccttcaacatgatcctgggaggaatcgtggtggtgctggtgttcacagggtttgtgtgggcagcccacaataaagacgtccttcgccggatgaagaagcgctaccccacga

SEQ ID NO: 28412 - DNA, 331 bp, Homo sapiens
aggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggctttaatatcagatcaaatctcaccaagcataaaagaacccatactggagaggaatctttaaatgtgatatgtgtggga

SEQ ID NO: 28413 - DNA, 324 bp, Homo sapiens
gtcaaagaacagatttatttgcattgtgttctgaggataatgccggagccatttgtccttaataaacagaaagcatagaactcaaggaaagctcttaataagaatgggttccggtgagggagctaatttcataaaatagtgccgagaaaaagaaacagacttttgttaaatgggggcagaagctgccagtggattttcacgtttgagatttctttcttttttaatttaaaatccaggacactcaagttacgattcccacagcaacagtaattttgtctgatgcatcaatgacatttctgttgaggaaaaatctctgtttttcct

SEQ ID NO: 28414 - DNA, 372 bp, Homo sapiens
atgatcacggacgtgcagctcgccatcttcgccgacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacacatacaaagcaactacacctggatttttccaaacaacttttatttcctcagagtcttccttaatcctatggaacaagaagctgccactgaatagggcccagtataggggcttgcttttctactccctccccccaatataaaaatatagacttttga

SEQ ID NO: 28415 - DNA, 328 bp, Homo sapiens
  misc_feature 5, 180: n = A,T,C or G
caagnactcaaacctaactcttctccaggaaaacatatgcaactgactctttattagattgttttggaaactttttattttactggtcaatcaagtttagtgacctatttgatattcaggtatgtgcacaatgtagacatttttcaaattaccgtatgaatttagataatatctcctatngagaaagaaaagactatcacatggaataaccttgatttgttaatctggctagcacatttgccattgttatatctattccctgttgaaaaagccttcttgtcagacttgtcatatgctggttgtataactggtaattacagaatcaaga

SEQ ID NO: 28416 - DNA, 299 bp, Homo sapiens
atgtcgaagcgaggacgtggtgggccctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaaga

SEQ ID NO: 28417 - DNA, 298 bp, Homo sapiens
  misc_feature 178: n = A,T,C or G
agatatcagtaaggcagtaggatttctggaggaagtgcattccatgcagagaggaagataaatgcaaaggctctaaggcagaagcctattgtgtgtgtttgaggaataaccattaggcccatgtgactggagcagggtgagaaagtgggaaaggagtaagatataaagttggaaaggnagtgaggatagaagatgcagggcttattgaccttcctgaggctcttgtcatttactctgaatgtgatggaagccactggaatatttggagcagaggaatgatgtgtttggacttgtacat

SEQ ID NO: 28418 - DNA, 323 bp, Homo sapiens
  misc_feature 27, 29: n = A,T,C or G
atattctgccgctttcatccaacgttntngcactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgtaacgcattcatgaatttccagtgttcagtaaatagcagctatgtgtgtgcaaaataaaagaatgatt

SEQ ID NO: 28419 - DNA, 134 bp, Homo sapiens
  misc_feature 134: n = A,T,C or G
gtgtgcctgtagtcctagctacttgggagtctgaggtggggggattgcttaagccctggaggttgaggctgcagtgagtcgtgattgctctgctacactccagccggggtgatggagccaagaccttgtcacan

SEQ ID NO: 28420 - DNA, 261 bp, Homo sapiens
tgctgtgccacgtgtctcaccaagcacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggttttttta

SEQ ID NO: 28421 - DNA, 323 bp, Homo sapiens
  misc_feature 175: n = A,T,C or G
aagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagntcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaaga

SEQ ID NO: 28422 - DNA, 119 bp, Homo sapiens
  misc_feature 2: n = A,T,C or G
gnggtgcatgcacacctgtagtcccagctacttgggtggctaaggcgagaggatcacttgagtccaggagtttgaggctgttagtgagccatgattgtgacatagcaagaccctgtctc

SEQ ID NO: 28423 - DNA, 282 bp, Homo sapiens
acctactggtgtttggcagaaatctgagactggcaccagacacaaattttagacatgggtatcttccctccagtaattcactgctcagagtaatctagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatg

SEQ ID NO: 28424 - DNA, 101 bp, Homo sapiens
  misc_feature 25: n = A,T,C or G
ctcccccctccccaataactgtggnctatacagagtcaatatattttttcagagaaagttattcgctcgattttttctgaatcataattaaactttatgac

SEQ ID NO: 28425 - DNA, 342 bp, Homo sapiens
  misc_feature 22: n = A,T,C or G
gatgagggggatattgccttgncgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgaga

SEQ ID NO: 28426 - DNA, 344 bp, Homo sapiens
  misc_feature 4, 21, 179, 182: n = A,T,C or G
atgntatcaaatcaaggctgngtaccttttatttccttggtctttttttagactccataatctgaatcattgtttttatcagatgccaaatcttctattttcatttgttaatcataatttatcattaggaaaccaaattgtgcattgttcatttcttatttagattatgcttaataacnagnaggttatgattcttatagactgctggagagtggcctgggtaaggaacacatctctctgaaatattacctctattgtgacatgactaaatcattgatgtaaatgattaggaaacttaaaacctacttaacacattgtatttttttttcttcttttgggattta

SEQ ID NO: 28427 - DNA, 315 bp, Homo sapiens
  misc_feature 23, 179: n = A,T,C or G
cgaggactttgattgcacattgntgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgnaatgcaaaatttttttaatcttcgccttaatacttttttattttgttttattttgaatgatgagccttcgtgcccccccttcccccttttttgtcccccaacttgagatgtatgaaggcttttggtctccctggga

SEQ ID NO: 28428 - DNA, 255 bp, Homo sapiens
agtcccagcactttgggaggccgaggttgggggatcacttgaggtcaggagttcaagaccagcctggccaacctggcaaaaccccatctctactaaaaatacaaaaaaagtagctatgagtggtggcacatgcctgtagtcccagcttctccggaggctgaggcagtagaatcacttgaacctgggaggcagaggttgcagtgagccgagatcacgccacggcactccatcctgggtgacagagtgagactccat

SEQ ID NO: 28429 - DNA, 245 bp, Homo sapiens
  misc_feature 182: n = A,T,C or G
attaatccatcaaaaatatttatcccgagaatactgactgcagcagtttgtaaggacgtaacctgaatgtccagtaggagaaatggttaagcaaattatgatgtatctggattctggaatatgtacctgttaaagaataaggtagatttggacatactgtcttaagaggacaaaaaaactgnacgataatgtttgtcgtagcatcacatttttagcaaatacatatatgcatgtgtgtctatgtt

SEQ ID NO: 28430 - DNA, 193 bp, Homo sapiens
  misc_feature 24, 178, 182: n = A,T,C or G
ctctagggacttggtgttgcttgnaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagntgcntcaattgaaga

SEQ ID NO: 28431 - DNA, 327 bp, Homo sapiens
ggtctgttacctgttttccccaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcaca

SEQ ID NO: 28432 - DNA, 127 bp, Homo sapiens
  misc_feature 126, 127: n = A,T,C or G
cgatgaagaacgcagctagctgcgagaattaatgtgaattgcaggacacattgatcatcgacacttcgaacgcacttgcggccccgggttcctcccggggctacgcctgtctgagcgtcgcttgcnn

SEQ ID NO: 28433 - DNA, 278 bp, Homo sapiens
  misc_feature 181: n = A,T,C or G
aaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggntaatgataacaatgcatcgtaaaaccttcagaaggaaaggagaatgttttgtggaccactttggttttcttttttgcgtgtggcagttttaagttat

SEQ ID NO: 28434 - DNA, 383 bp, Homo sapiens
  misc_feature 8, 9, 33: n = A,T,C or G
atggaccnncactttgaagacaaaaaagaaatnttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgc

SEQ ID NO: 28435 - DNA, 336 bp, Homo sapiens
  misc_feature 6, 329: n = A,T,C or G
cattcncctattcttttatctcagaactgtttttagctattatactcctttgcctttccatataagttttagcataatcttgcataagctcgcaaataactgatgggaggttttgcttgaccttctccctcattttcatctggcccacttttcttacacctgcttcttctttattgtctatcttgtcttatatgattgtctacatagaaaatctcaaataatctacacaaaaatgtaaataaaaaaccctagaaccaaaaggtgagttcagcaagttcgcagaatataagatcaacagacaaaagtcaattgtatttctcaatagtggngagtatg

SEQ ID NO: 28436 - DNA, 324 bp, Homo sapiens
gaatagtctacaaaggaagacttgcaacctggagaagagacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaaggtgtgtggttctggttttgaaagttattctttatcttggtacatggaattttagagccttttgcatctgaaaaatgttatattgttagaaattgccctgaagaactataattacagaaatgcaggtatatattaatg

SEQ ID NO: 28437 - DNA, 226 bp, Homo sapiens
  misc_feature 19: n = A,T,C or G
gtgtgcttatgtctcttgngacaatctgttttcctccctgcccctggaggttgtcttcaagctgtggacttctgggatttgcagattttgcaacgtggtactactttttttttctttttgtctgttagttatttctccaggggaaaaggcaataattttctaagacccgtgtgaatgtgaagaaaagcagtatgttactggttgttgttgttgttgttgtttttta

SEQ ID NO: 28438 - DNA, 332 bp, Homo sapiens
  misc_feature 22: n = A,T,C or G
ggcagctcgggactgagtgccngaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttga

SEQ ID NO: 28439 - DNA, 189 bp, Homo sapiens
  misc_feature 25: n = A,T,C or G
acatggggaaaccctgtctttactnaaaatacaaaaaaattagctgggcatggtggtgcatgcctgtaattccagctactcaggacgctgaggcaggagaattgcttgaacttgggaggctgaggttgcggtgagctgagatcgtgccgttgcactccagcctgggcaacaagagcgaaactccatccc

SEQ ID NO: 28440 - DNA, 417 bp, Homo sapiens
  misc_feature 25, 179, 180: n = A,T,C or G
acaaacccacagccattatcatacngaatgggcaaaagctggaagcattccccttgaaaactggcacaagacagggatgccgtctcaccactcctatttaacacagtattggaagttctggccaagaaaatcaggcaagagaaacaaataaggggtattcaaataggaaaagaggaagnnaaactgtctgtttgcagatgacatgatactatatctagaaaaccccattatctccacccaaaagttccttaagctgataagcaacttcagcaaagtctcaggatacaaaatcaatgtgcagaaatcacaagcattctatacaccaacaatacacaagcagagagccaaatcatgaatgaactcccattcacagttgctagaaagagaataaaatacctaggaatacagctaataaga

SEQ ID NO: 28441 - DNA, 290 bp, Homo sapiens
  misc_feature 176, 181: n = A,T,C or G
agatttggctgtctccgctcatagctgcttttggcgcgaaagatgccgggtctggttgactcaaaccctgccccgcctgagtctcaggagaagaagccgctgagccctgctgcgcttgcccggagaccaagaaggcgcgcgatgcgtgtatcatcgagaaaggagaagaacactgnggacntctaattgaggcccacaaggaatgcatgagagccctaggatttaaaatatgaaatggtggtctgctgtgtgaataaataattcctgaagaatgaagaagattaattttg

SEQ ID NO: 28442 - DNA, 259 bp, Homo sapiens
  misc_feature 25, 176: n = A,T,C or G
atgagccactgggtgtaccagtgcnttaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtntggatatggtagtgtgtggttctcttttggaatttttttcaggtgatttaataataatttaaaactactatagaaactgcaga

SEQ ID NO: 28443 - DNA, 125 bp, Homo sapiens
  misc_feature 123: n = A,T,C or G
aaaacagggctggtattcctacccaggaacctcctttgagcatagagttagcaaccatgcttctcattcccttgactcatgtcttgccaggatggttagatacacagcatgttgatttggtcncc

SEQ ID NO: 28444 - DNA, 318 bp, Homo sapiens
  misc_feature 175: n = A,T,C or G
actcactgccttgagcctgctccctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtncaggccacgatattatctttacaagcatgcctacttttatcctcatttaaaacgatttccagttcagggcagtagtgactcatccgaagaaaatggagatgacagttcagaagaggaggaggaagaagaggagacttcaaatg

SEQ ID NO: 28445 - DNA, 304 bp, Homo sapiens
  misc_feature 179, 180, 182: n = A,T,C or G
tgtgtgcctggtgcggagctacccgggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatnngnagctgtcagagggaaagactgtgcagtaattgtcacacagaagaaagtacctgacaaattattggattccagcacagtgactcacttattcaagataactgaaaacattggttgtgtgatga

SEQ ID NO: 28446 - DNA, 310 bp, Homo sapiens
  misc_feature 302: n = A,T,C or G
gatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaagcaaaaagctaagggcaaaatgtacaaacttagaagaaaattggaagatagaaacaagatagaaaatgaaaatattgtcaagagtttcagatagaaaatgaaaaacaagctaagacaagtnttgggaga

SEQ ID NO: 28447 - DNA, 274 bp, Homo sapiens
  misc_feature 17, 22, 177, 178: n = A,T,C or G
caaccatctgtacattngtccncttgccaaattgaggcggagaaaattgaaaaaagaagaaaaactgaattggaaatttttattcgggtaaaaaagtgatgcttttcaaattgatctaggataaagatgaagacctgacaattatcagagttatatgatattaataaaatgattagnngaaagagttgtaatagatttcaagtgttctaggtgcataatggtgaatgacctcaggcagttcactacagttctgttgagttatgttctccctttg

SEQ ID NO: 28448 - DNA, 329 bp, Homo sapiens
  misc_feature 25, 179: n = A,T,C or G
agaatcttgctgctcggcccccagnagagcaacaactcaacgggaacgatgtggaaggtgtcagctctgctcttcgttttgggaagcgcgtcgctctgggtcctggcagaaggagccagcacaggccagccagaagatgacactgagactacaggtttggaaggcggcgttgccatgcnaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaaga

SEQ ID NO: 28449 - DNA, 268 bp, Homo sapiens
aaacaccttcatcatgggactctcagagtggggtccgttttggtttcctggtggtgggttttgaaagataagggaaagcacattttgagcatgtctgggtaccatggtgcggatgcttgggaaccagaactgtttcagaggaatctgaagtctgattttagttttcagagacacagcttgttgtaaaacatgagaagacatgatttctaggactcaagcagcaagccaggattctaggttggctgctgtgtcatctttgaagtcaaga

SEQ ID NO: 28450 - DNA, 279 bp, Homo sapiens
cctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggat

SEQ ID NO: 28451 - DNA, 346 bp, Homo sapiens
  misc_feature 22: n = A,T,C or G
cttaagaaaaaaattgtgaacnccaatgtcaaactttgcagatgcaaccaagggtagattcagagccaaatttgtagttttatattctttgcattttaaaaaggggaaaatagaccaggcgtggtggctcacgcctataatcccagcactttgggaggctaaggtgggtggatcacttgaggtcgggagtttgagaccagcctggccaacatggtgaaaccctgtctctactaaaaatacaaaaaatagctgggcgtggtgcaagtgcctgtagtcccagctaattgggaggccgagacaggagaattacttgaacctaggaggcagaggttacagtgagccaaga

SEQ ID NO: 28452 - DNA, 406 bp, Homo sapiens
  misc_feature 390: n = A,T,C or G
aagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccanaaactgcggttttaga

SEQ ID NO: 28453 - DNA, 342 bp, Homo sapiens
  misc_feature 180: n = A,T,C or G
taaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgntttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcaga

SEQ ID NO: 28454 - DNA, 196 bp, Homo sapiens
  misc_feature 17, 177, 179: n = A,T,C or G
atcctggccaacatggngaaacccagtctctactaaaaacacaaaaattagctgggcatagtggcaggtgcctgtaatccaagctactcgggaggctgaggtgggagaatcgcttgaacctgagaggtggaggttgcagtgagcggagattacaccattgcactccagcctggatgncngagcaagactccatctc

SEQ ID NO: 28455 - DNA, 154 bp, Homo sapiens
  misc_feature 25, 153, 154: n = A,T,C or G
aattagccaggtgtgatggtgtatncctatagtcctagttattcaggagcctgaggcagaaggatcacttgagctgaggaatttaaggttgcagtgacctatgattgtgccactgcatttctagcctgggtgacagagtaagactctgtcgcnn

SEQ ID NO: 28456 - DNA, 276 bp, Homo sapiens
  misc_feature 25: n = A,T,C or G
ctggctgccagaaactcattgaagnggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattg

SEQ ID NO: 28457 - DNA, 327 bp, Homo sapiens
caataagtgacaccagtgatgctgttaaacaaggacaatccggttcatggattgtgacaacgcacgctgacatcaagcagaccctgccgtcagctgagtgccatgagaggacagtgacaaccttggggcctcatggtgaaggtggcagaaactttgttagcctgggtgctcagggtggacagctgctcttgccaaccgggaacatttgccttgagctcttttgtaagtgacagataagcttttattgtacttcagccaagatacaaacattggacgtatttgtacagcagctaaaggtactataataatacatattctgaaatcact

SEQ ID NO: 28458 - DNA, 268 bp, Homo sapiens
attctaaggaattgttctggtcagaatctggagttttcaactcccttctgtggtccatttttattatggatgctgctttgaaggatggataaagtgctaggaaaagttgttatcatctaaaaaaccagaattctttctactcaaaggtcttgttctctaccatgttcccggtgggacattttctctgtagttttttccaatatatagtaggttaccgacaggacactgcttatcctcacaaggaaggcacttctgttaataattcagc

SEQ ID NO: 28459 - DNA, 104 bp, Homo sapiens
  misc_feature 21, 57: n = A,T,C or G
acgatattatctttacaagcntgcctacttttatcctcatttaaaacgatttccagntcagggcagtagtgactcatccgaagaaaatggagatgacagttcag

SEQ ID NO: 28460 - DNA, 160 bp, Homo sapiens
  misc_feature 53, 83, 102, 140, 145: n = A,T,C or G
ggaggcattgaggcagccagcgcaggggcttctgctgagggggcaggcggagnttgaggaaaccgcagataagtttttttctntttgaaagatagagattantccacctccttaaaaaatatagccaataggttactaanatatngcttagcgttaagtt

SEQ ID NO: 28461 - DNA, 453 bp, Homo sapiens
agaccagaaaataccatttgacccagcaatcccattactgagtatatacccaaaggaatataaatcatgctactataaagataaatgcacatgtatgtttattacagcactgtttacaatagcaaagacatggaagcaacctaaatgcccatcaataatgagaccggataaagaaaatgtggtacatatacatcatggaatactatgcggccataaaaaggaatgagatcatgtccttttcaggggcatggatgaagctggaagccatcatcctcagcaaactaacacaggaacagaaaaccaaacaccgcacgttctcactcataagtgggagttgaacattgagaacatgaacacagagaggggaacaacacacaccagggcctagtagggggtaaagggtgaggggagggaatttataggatgggtcaataggggcagcaagccaccatg

SEQ ID NO: 28462 - DNA, 441 bp, Homo sapiens
  misc_feature 29, 211: n = A,T,C or G
atctatctacccgacagcagcgaccgagnacccggtgggacactccccttctccccactttcacctccccacccaaactttataaaagttgaaaaaatatcatttgactttttatagaaaaaaaaaggaaaaaataattgagaaagtgttcatctgaggactgcatcggtggacactggtatttatttatgttagctccaagcggaccggnggttcaaaagtgcattatttagtttgagctctgtaggtaaaaaggaggtgggaaaaattttaaaacttgagggtaaaaatgtggaaaacaaaccctcccatcccttgtagattataaataaaagcaaaaccgccacagaactagaggtcttctctttaatgttactttaaaattgctatgattgtattgtaccgttatttaatgtctgattgaaacacaaatttacatgc

SEQ ID NO: 28463 - DNA, 269 bp, Homo sapiens
  misc_feature 19, 21: n = A,T,C or G
ctccctgggaattccggcntntatggcccgggccccctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagaacaaaaaatctgccagcgttatgatcagctcatggaggcatgggagaaaaaagtggacagaatagaaaataatcctcggaggaaagctaaag

SEQ ID NO: 28464 - DNA, 109 bp, Homo sapiens
  misc_feature 17: n = A,T,C or G
tcagcagagaaggttantttaaagatcagagccacctttcagtacctgttgctggcaataaaaaaaagtttagtgaagtaaaattctatcaaggacaaaaattctacca

SEQ ID NO: 28465 - DNA, 429 bp, Homo sapiens
  misc_feature 9, 14, 35, 36, 41, 45, 73: n = A,T,C or G
ctccggccntctantgggcccgggaaggaaggaannagganattnttgaaaaatgaatagattgggaaaagantcaagtgtttagaaatgaaaaatatggtccttaaaattaaaaattcagtgaatgggttaaacagcagagataaggccgggtgcggtggctcacgcctgcaattccagcactttgggaggctgagacaggtggatcacttcaggccaggagttcaaggccagcctgggcaacatagcacaactccgtctctactgaaaatacaaaaaattagccgggcttggtggtacacgcctgtaatcctggctgctcgggagggtgaggcatgagaattgcttgggcccgggagacggaggttgcagtgagctgagactgcaccattgcactccagcctgggctacagagcgatactctttccg

SEQ ID NO: 28466 - DNA, 440 bp, Homo sapiens
ggggcattcctgagctgacagcattcgggccgagaatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagccccaagatagttaagtgggatcgagacatgtaagcagcatcatggaggtttgaagatgccgcatttggattggatga

SEQ ID NO: 28467 - DNA, 155 bp, Homo sapiens
gaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtcgt

SEQ ID NO: 28468 - DNA, 146 bp, Homo sapiens
  misc_feature 9, 16: n = A,T,C or G
atgaaaganttatttntattgataaaaatatatttagcttttcaaagcacaagactgaatagaagtgctctttttatgctttctggagatgttactgttaaatgtctttctacatcaggcttaataaatctgtaatgacatttgat

SEQ ID NO: 28469 - DNA, 453 bp, Homo sapiens
  misc_feature 304, 318, 412: n = A,T,C or G
ggaaccaaaagcaaacaaaaagaaatctctctataaaatgaataaaatgtttaagaaaagagaaagagaaaaggaattaattcagtgaaggatgattttactcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgngggggagggttggnggtatatttttcccctcttttttccttcctctcctacatctcccttttcccccgatccaagttgtagatggaatagaagcccttgttgctgtanatgtgcgtgcagtctggcagccttaagcccacctgggcact

SEQ ID NO: 28470 - DNA, 111 bp, Homo sapiens
  misc_feature 19, 31: n = A,T,C or G
ctttcaatgatgcttaccntctattttagcnctgagccttttattatttgcctatttgtaaagtttatttgtcttaactcatttaataaatatactgtttatctgtttctg

SEQ ID NO: 28471 - DNA, 429 bp, Homo sapiens
  misc_feature 3, 10: n = A,T,C or G
aanctcggcntttattggccgggatattgaaaaccctttaaaaaaggaacaaaaattagaaaaccttaaagatgccaccagaaaaacctgttagatctaatacatgaattcactgaagttgcaggatatgaaatcaacttataaaaaccagtattgtttttatgtactaatagtgaactacctggaaaaaatatcaagaaaactctatttacaatagctatgaaaaaaatacttagaaataaatttaagcaaggaggtgaaatatctgtacattgaaaactataaaaaacattgatgagagaaattgaaggagacacaagtaaatgttcatggattggaagaattagtattgttaaaatgtccatactacccaaagcggtctacagatttagtgcaatccctatcagaaatatcaatgacattcttcac

SEQ ID NO: 28472 - DNA, 470 bp, Homo sapiens
ggagctttaatttattaatgcaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattata

SEQ ID NO: 28473 - DNA, 425 bp, Homo sapiens
gtgaccctacatattaaatccgcatcctgaacatccagagctgtgactgtccatttctttgttattaagcagatacttactgtcaatctggatgttttgtgatgaggggaatcaatagatgtgtgagctttggtcttgaccttagggtaattacatatacttgtaaagtgaggcatatgtgattttaatcacataccatctgtgattaaaaaaattgaagaggaatacaaggatttagaataacgaagaagacactagatttattcttggattgaatcatttgggaagtctttatggatgcgggggtggttaagttgggtcttgagaaatagaggaaaaatttcctgaatgtctttgaagttttcatgttaatgctgatgaaaagaaagtgcatttagtaggttggaggagagtccaaattaatg

SEQ ID NO: 28474 - DNA, 224 bp, Homo sapiens
  misc_feature 4: n = A,T,C or G
atcnatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaac

SEQ ID NO: 28475 - DNA, 473 bp, Homo sapiens
gattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagacca

SEQ ID NO: 28476 - DNA, 353 bp, Homo sapiens
  misc_feature 128, 135, 261, 287, 337, 338, 339: n = A,T,C or G
tacagatatgatcataactgaaccgcaatttggattatagaagtgcacttcctagctgttttttatttaggtataggaacacacaatgagaaccttatgtttagaatgtagcagtaacaacagagggnaactacnctgcaagacttaaatggtttgagcatgtgacactatccttttgttggggggagcagggtataaaaatatacatacaggagattagtttaatggtaaagttttatatgtatgtttaacttccatggnatttattattttgtagagacatttgngattgtttagagttctagtttttattctatttatgtataaggttgacttnnnttaaataaataagc

SEQ ID NO: 28477 - DNA, 368 bp, Homo sapiens
  misc_feature 6, 7, 67: n = A,T,C or G
tcggcnntttatggcgcgggggcccctccctccccttttcctgccccgtcccatgcctcagcttgcngcttgtgccagttgcctgtttcgcttcagtgtttgattctagcacttacatgtgtcctccccaccaagccctctatctccttctaatccttcaacccctggccccctccccataacagtgacttttccagggaggaagaggcagcaggagctgttggccttggtttgacagagcgggtagggctgtagggaaagcgggtgagctgttgtgctgctgggcctccctttggccctcgcttcccaccctacgatgtatgaaatgtatgtacagaccagagatgtttatacagccgataaagatg

SEQ ID NO: 28478 - DNA, 197 bp, Homo sapiens
  misc_feature 10: n = A,T,C or G
atcaggaccnaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttcctc

SEQ ID NO: 28479 - DNA, 418 bp, Homo sapiens
gctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtg

SEQ ID NO: 28480 - DNA, 368 bp, Homo sapiens
gaatattatttttgaagatatacacacaaaaactttaaaatagaatgttgggaatgctaaccctacagctcgcattgtcacgtttagtccattccacaaacggaatggtaatgtgcttagtagctaagtatgtagaagcctccccacccccggcccagcaaaaaaaacacagtaaccttatccatgagaaaaatatgataatattcattgacaggggagctacaaggagcaattttcccaagctgtgtctttcagacaatgctgtcagtttttccactttgatgactacagctggggttgtgatgcaaggacaagaaattacagtgtggctagaagatcagggcattggctatgctgttagctataca

SEQ ID NO: 28481 - DNA, 235 bp, Homo sapiens
caaaaactgaagtacaccaccaatgtcccaattatgaagttgaatacagaattataaaaaaaaattgttgaaagtcaataagaataaatcttagaatttggactcctgccacatggcagaaaaaaagcatgatgttttaagacaacctggcctttgtccaacatgatgtttaccagattgctgacattttctagcataacaatactattcatcattgggataaccaaaagaaggg

SEQ ID NO: 28482 - DNA, 246 bp, Homo sapiens
tgcaagaaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccctgaccgtttgctatattcctttttctatgaaataatgtgaatgataataaaacagctttgacttgc

SEQ ID NO: 28483 - DNA, 334 bp, Homo sapiens
  misc_feature 16, 197: n = A,T,C or G
gcataaaacactaacntaaagaagatgacattaagaaaccaaatacgctgggtgacgtgactcttgcttatagtcccagtaactcaggaggctgaggcaggtggatcgcctgaggccaggcgtttgagaccagcctgatcaatatggcaagaccccatcttaaaaaaaaaatttttttttaattagccggacatggnggtgggcactttgtggtcccggcaacttgggaggctgaggcaggaggatcacttgagcttaggtgtttgaagctacagtgagtgagctttgatcccaccactgcactccagcctgggcaacgggagcaacaccctgt

SEQ ID NO: 28484 - DNA, 456 bp, Homo sapiens
ggctttcttgggaagatggcggctgtgtcagtgtatgctccaccagttggaggcttctcttttgataactgccgcaggaaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggcatcaaggttacattggtgcagccctagttttagggggagtaga

SEQ ID NO: 28485 - DNA, 468 bp, Homo sapiens
aagattcgtttggtggagagctgaaaatgtttcttaattgtgtttatatttccctaggcatggcccttcctggtatgtactttaactttccaagtagctaaattattataattatatatgttaaattaactggaaatggttaagaacataactaaaagaaaatctacattaaccagttggaatcgctattagttcatgatccaaccagctatagtagaataacactgtatttttctttagactggagtccaaacaacaggaaatttcccaaccagatgtagctattgtgtatgatgtagcatttggctgacaaaagtaaacttgtttctaaattatcattgtacatcttgttcctgagtcttttacatttatgatcctcttccaatgactgttggtcctcatttagtttcacaaagctggaaattttttttcctacagtgtttataaaagattttaagttgatgaaga

SEQ ID NO: 28486 - DNA, 322 bp, Homo sapiens
  misc_feature 4, 140: n = A,T,C or G
ggcngccgcctccggaactaaacggggtgaggtcacattcggttatctctaacgttggaaaacgatggagctaacacccattatggagattaaccacttttcatcaggtttttaacttaagtcgtgaggaatacaacggngaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgt

SEQ ID NO: 28487 - DNA, 274 bp, Homo sapiens
gggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacact

SEQ ID NO: 28488 - DNA, 355 bp, Homo sapiens
agggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcaga

SEQ ID NO: 28489 - DNA, 446 bp, Homo sapiens
  misc_feature 17: n = A,T,C or G
gtctttttaatactgtnccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaacgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttat

SEQ ID NO: 28490 - DNA, 380 bp, Homo sapiens
  misc_feature 25: n = A,T,C or G
atccacctaagtattttcaacaagnaggcatctcagggagtggggagacactctaggggcccagcaaatattaactaattatttttaaaatataaatactgcttatatactaatactgtttgaattgtttgaatttatgactaaacatgtgtagcttttatgtattttgaatttatcactcacaatttttgaagcaatgcttctttatatattttcctgagaagtggccagtagattatgtgtggatgggaaacctgaaatacagcacagctcaaaatgttttacgaaggacatgtcactgaaattcctaactaaatatttacgctgaatattgagttagatgaaagaacactagaaaacatatcatagtttttaaatat

SEQ ID NO: 28491 - DNA, 221 bp, Homo sapiens
  misc_feature 36: n = A,T,C or G
agtcttagtaagaaataaattacactaaactatttnaatggagaggatttttaatacatgaatttgttatactggctgaatgattaataagggggatgctgaggctgggcattgtggttcacacctgtaatcctagcactttgggagcctgaggtggaaggatagcttgagcccaagagttcgagatgagcctgggcaacatagtgagacttggtctctac

SEQ ID NO: 28492 - DNA, 473 bp, Homo sapiens
caaagacttctactggagagaaaccttatatgtgtactgaatgtggaaaatccttctctcagaaatcacctcttatcatacaccagagaattcatacaggggagaaaccttatcagtgtggtgaatgtggcaaaaccttctcccagaaatcactcctcattattcatctgagagttcacacaggggagaaaccctatgagtgtactgagtgtgggagggccttttccctgaagtcacatctcattctacatcagagaggtcatactggagagaaaccctatgaatgtagtgaatgtggaaaggccttctgtggaaagtctccactcattatacatcagaaaactcatcctagggagaaaacccctgaatgtgctgagtctggaatgacttttttctggaaatcacagatgattacatatcagagaagacacactggggagaaaccctccagatgcagtgactgtgggaaggca

SEQ ID NO: 28493 - DNA, 111 bp, Homo sapiens
agaaacttggcgatcacgttttcacatgatgctcacgctcagggcgcttcaattatccctccccacaaagataggtggcgcgtgtttcagggtctctcgtctctctcctac

SEQ ID NO: 28494 - DNA, 432 bp, Homo sapiens
  misc_feature 84: n = A,T,C or G
ggctttccaacttggacgctgcagaatggctcccgcaaagaagggtggcgagaagaaaaagggccgttctgccatcaacgaagnggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttat

SEQ ID NO: 28495 - DNA, 204 bp, Homo sapiens
  misc_feature 7: n = A,T,C or G
tcggccntttattggccggggggtgaattgtttttgtcctcattctgtacagaaatttgtatatatgatggttcttagaacttgttttaatttttgtggtccttctgtttattataataggcgtccaccaatgattatccatatgtgttcttaatttttaactgctggaagtgttaaaacacacacacacacacacacacattt

SEQ ID NO: 28496 - DNA, 488 bp, Homo sapiens
  misc_feature 5, 6, 125, 217, 264, 306, 321, 430, 432, 476, 479, 482: n = A,T,C or G
cggcnntttatggcccggggggccctgcaggcgcccatggtcttcctcaccgcgcagctctggctgcggaatcgcgtcaccgaccgctactttcggatccaggaggtgctgaagcacgccaggcncttccggggaaggaaaaatcgctgctacaggttggcgggtcagaaccgtgattcgagcctttgtgaaatgcaccaaagcccgatacctgaanaaaaagaacatgaggaccctctggattaatcgaattacagctgctanccaggaacatggactgaagtatccagcgctcattggaaattnagttaagtgccaggnggagctcaacaggaaagtcctagcggatctggccatctacgagccaaagactttcaaatctttggctgccttggccagtagggaggcgacacgaaaggatttccttgcntncttggggggatgggaaaggaaccctgaaggcatttttttccaanagnggngcagta

SEQ ID NO: 28497 - DNA, 397 bp, Homo sapiens
ggaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagcttgcctctgccaggagtctaccaaatgaagaaatagtgcagaagatagaggaagtacttttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaagaagaaaaag

SEQ ID NO: 28498 - DNA, 498 bp, Homo sapiens
  misc_feature 2, 14: n = A,T,C or G
cngggaattcggcnttatggccgagctacttggataactgtggtaattctagagctaatacatgccgacgggcgctgacccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcaggatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggcttgacaggctccaaacaggcatgcgaggtgcctttggaaagccccagggcactgtggccagggttcacattggccaagttatcatgtccatccgcaccaagctgca

SEQ ID NO: 28499 - DNA, 452 bp, Homo sapiens
  misc_feature 50: n = A,T,C or G
gaaaagaaaaaatagctttcaagcaaactcagaattgtagtgatcttgcntgtggtactaagcttgacagcttcctaataattaaaaactcttctgatgctatcagtggtgatgttcaaaaatgtcaatttttaaatattatagaataaaatgtgccaacattttagaagatttgcataactcagtgaaccaatacttttcaaatgaccaaaacataatgttacaaaatcatgcatggataaaaggtgcattgaaaatgcaaatgaggccaggtgtggtggctcatgcctctaatcccagcattttgggaggcagaggctggaggatcacttgaggccaggcatttgagaccagcctggccaacatagcaagatcctatctctaaaaataataagagtaagagaattagccaggcatggtggcatgccccgtgaagtcttagctacttggga

SEQ ID NO: 28500 - DNA, 469 bp, Homo sapiens
  misc_feature 75: n = A,T,C or G
ctgggactcggtctcaggggatatgcctaccaatagcgggtatcgtaaggcatgtacccaaacataacggatgtnaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatca

SEQ ID NO: 28501 - DNA, 214 bp, Homo sapiens
agaaaaattagaaattattaactttattgaataagcagaagtgcatcctaatcctttgattattaatgaggttgaatatttgtgtgctatcggtagctgtgtttctttgatcagatgttcctgtccttttgcccttctgttatctgttggagttgctttgtttttcgtatcaagttataggatctctttatataataaatgtaatttaacttgc

SEQ ID NO: 28502 - DNA, 177 bp, Homo sapiens
  misc_feature 6, 168, 177: n = A,T,C or G
gaaacnagtagccgctggggtgttaatggtagcattcttcttttggcaatacatttgatttgttcatgaatatattaatcagcattagagaaatgaattataactagacatctgctgttatcaccatagttttgtttaatttgcttccttttaaataaacccattggngaaagtcan

SEQ ID NO: 28503 - DNA, 146 bp, Homo sapiens
gtatgagggagccttcagaggtgccctaaataatctgtatctcgatctgggtggtgcttgtgtgggtgtatgtataatacataaaaatttatcaggcagtacacttaagatttatacacttaatagtatctttgttatatctcaac

SEQ ID NO: 28504 - DNA, 460 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgccttttcccatctgtctatctatctggctggcagggaaggaaagaacttgcatgttggtgaaggaagaagtggggtggaaga

SEQ ID NO: 28505 - DNA, 166 bp, Homo sapiens
  misc_feature 10: n = A,T,C or G
gtggtaaccntaaatctcacctacgtaggctctttaaagcagaaataagaagggaaggcaacgtggtatagaaccagattccaatgagcctgaaaaatagctggctaattttctaagaaaagaactaagaaagaaaataaagaaagaaaataaagaagttatagac

SEQ ID NO: 28506 - DNA, 472 bp, Homo sapiens
gggcttatctgtaaaacacagactagacgatcccatttcaatgctgcgaatcggctaatgagcaacactggagcacaggactggttgaaataggctcccaaatgtagaaacataaatatactctcacttacttatgatctaggcagaatgacttacctagaacttgggaacagatatagtacacgaacagtgaactgcctgtttttgacaacacagacaccacctattgaaggctatacacaagcatgaactcactctcccttttagcctataaagtagatcttactgtttaacaggtaaaatggggctgattaaggctgagcaatcaccaagtgtcagaccgcgtgccaaactccacactgtaagatgcgtcacctaaacagcatgctcaggcatgaatgagccttaaaaggccacacagcacagtggttaagagggcggggcctggggttagactgacatcatctgaatc

SEQ ID NO: 28507 - DNA, 472 bp, Homo sapiens
aagacagggaggttccatttactgtaaccatttgggagaaacaaaattaaaacaaaaagtcctatagttgtattgattctgccaagaggatgtcgctttttaaagagaccgagaccgtatacttttactttaaaaagaaactacagatatagttgaactcaaaaacttctagtcattttttttctgagcgtttcattaaattgtgtttttccctatgaaatataaatattcagtttttatgttttacatctgtagatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggtaagtctgaagagattcctgagtaaggtaatattgccaccatatgtagaaataataaaattaat

SEQ ID NO: 28508 - DNA, 200 bp, Homo sapiens
  misc_feature 26: n = A,T,C or G
ggcttctcggccttttggctaagatnaagtgtagtatctgttcttatcagtttaatatctgatacgtcctctatccgaggacaatatattaaatggatttttggagcagggagatggaataggagcttgctccgtccactccacgcatcgacctggtgttgcagtacctccaggaacggtgcaccccctccggggataca

SEQ ID NO: 28509 - DNA, 473 bp, Homo sapiens
gacccgcactgagtcaacagactgagcgcgtccaggcctgacagctctgcggctcgggccctgaggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttc

SEQ ID NO: 28510 - DNA, 109 bp, Homo sapiens
agctgtgaattgttaaaatgtatgattcaggataaaacgtaaacacgtgctgttagtaatttcttgtggatttcattgttttgccttcaaataaagcctttttttaaag

SEQ ID NO: 28511 - DNA, 415 bp, Homo sapiens
cgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgcccct

SEQ ID NO: 28512 - DNA, 108 bp, Homo sapiens
ggggaggttgaggtaggaggattgcctgggccttggaggttgaggctgcagtgagcggagagcttgccactgccccccagcctgggtgacagggtgagaccctgtctc

SEQ ID NO: 28513 - DNA, 473 bp, Homo sapiens
  misc_feature 20: n = A,T,C or G
gatatttttaacttaagatngtgatttagaaatcaagtgaaaatcttgttaccatttgaatgaacatactgatattaataaaatgataagtattttacatgatcatccaagttagattttgacagaatgcctagggtcttggagtaaccagcttttggcaattcctggctctctttttcatattcaaatttgtaaagaaagcagagaagagtaaatgtgtgtaggtgtcttcctcctggaagtaggcacaaactgcatggaaaaccaaccaaaaaatggtaacagaaaaatatgataataatttatttaaaaataaaattcttagactttgtcataactagaagactatctagaattgtgaatgaagtaaggaccccaaataaagacgcatttctaattctcatatttctggcccatgcagcaaatattgggtatgctagatggaagaaaagatgttcaatatataacatcct

SEQ ID NO: 28514 - DNA, 474 bp, Homo sapiens
ggacataattggttgtattcacatagtaatgactaactattttttaggcatttccataagcttccaagcctcctctcttgtgatgatgtaaacatgagaatagctgctggtgaatctttggcacttctctttgaattggccagaggaatagagagtgtaagtatctaactggcagaggaaaaagcttgtgtcacaaggcccattgttccatcattaccttgcaattgagaattgggcaataactttggaacatggccagcttgagaacccagtgatttatttccctacttcttggcagtggtggtgtaatactttagagagcagaaaccagtaggggttggacagcagtgtttgactgtggttcattatacttaatttttgctatctatagaactgaagtttagggatcctcatggagagagttttgtctaatataatctttatgaaactgcttggatttctcagatacccaat

SEQ ID NO: 28515 - DNA, 338 bp, Homo sapiens
  misc_feature 1, 8, 14, 25, 44, 54, 78, 119: n = A,T,C or G
nactaaantactgnctactaagctntcccaccagcctttgcatnaaacacttangtacctgccgagattaggggggcncttttaagggaaaaaacttttaaaaaattaaatgccttggntttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctg

SEQ ID NO: 28516 - DNA, 472 bp, Homo sapiens
  misc_feature 106, 268, 274, 323, 368, 471: n = A,T,C or G
gaggcattgaggcagccagcgcaggggcttctgctgagggggcaggcggagcttgaggaaatcgcagataagtttttttctctttgaaagatagagattaatacanctacttaaaaaatatagtcaataggttactaagatattgcttagcgttaagtttttaacgtaattttaatagcttaagattttaagagaaaatatgaagacttagaagagtaccatgaggaaggaaaagataaaaggtttctaaaacatgacggaggttganatgaancttcttcatggagtaaaaaatgtatttaaaagaaaattgagagaaaggnctacagagccccgaattaataccaatagaagggcaatgcttttanattaaaatgaaggtgacttaaacagcttaaagtttagtttaaaagttgtaggtgattaaaataatttgaaggcgatcttttaaaaagagattaaaccgaaggng

SEQ ID NO: 28517 - DNA, 333 bp, Homo sapiens
gagagtgagagggcagaggaaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggagga

SEQ ID NO: 28518 - DNA, 361 bp, Homo sapiens
  misc_feature 53: n = A,T,C or G
agatgcaggaagctcaggtgatctgtttgaggagagcaccctaggcagcctgnagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaataagtaattcccgtacgtgttcattttattttcatgctttttcagccatgtatcaatattcacttgactaaaatcactcaattaatc

SEQ ID NO: 28519 - DNA, 411 bp, Homo sapiens
  misc_feature 5, 29, 31, 38, 40, 53, 54, 60, 61, 64, 65, 67, 105, 111,117, 147, 155, 157, 207: n = A,T,C or G
gattnctgatataattactgaagtacctntngcttaangngagaggttcaganntactgnnganntnaaccccctcttccgcatggagaaatatgaggcacaaanagattntgtggntcacccaaggtcacactacaagtcagtggnggagccangnatagaacccaagactcctgactcctaatccactcccctagccactagggnccttgctccctcctcaaggtttcctcttgtgtgaaattctcctttgaaatgcaatttcttgtttttaattcatggggaaagaagtacctgctctaatgcttctctaggatttgcctttattcagcatccaagtctaatgttcgagcaagaagtgaagaatctatataataatattttatctgataagaactcctcagtcaattt

SEQ ID NO: 28520 - DNA, 473 bp, Homo sapiens
gggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattg

SEQ ID NO: 28521 - DNA, 350 bp, Homo sapiens
tagtgggtagaagaaagtactaaggacaacaacaacaacaacaaaaacagccaagattgttatacatcaaaaatataatgccaccacaaaaagtaagccccttgagggcaagaactgtatcctgaccatatcctggtatcctgtccagcaaatcaagtttttcttttcttttctttttttgaaacagagtctcattctgtcacccagcagggagtgcaggtggtgccatcttggctcactgcaacctccgcctcctgggttcaagtgattctcctgcctcagcctcctgagtagctggattacaggtgcacaccaccatgcgcagctaatttttgtatttttttggaaga

SEQ ID NO: 28522 - DNA, 338 bp, Homo sapiens
attgatagtgtggtttattttgaatgaggagtttctgtcccttcaagcatgatagttttgggattcagcctgagccatagttccgtgtgtctgctgttgcccaccagagtgtcatctgcgacccaaatctcttaagagcttcaggcttctttctgcttgcctgcccaaccttccttagaaccccacttacctccagctcctcttgttatctccacaccttcagacgctctccattccctctaccacctcaaacagcagcagcagaccacagaagaccctgctgcagtgagccaagatcacgccactgcactccagcctgggtgacagcaagattccat

SEQ ID NO: 28523 - DNA, 332 bp, Homo sapiens
  misc_feature 1, 20, 23, 31, 61: n = A,T,C or G
nagaagtctgtgactacctngtnactacttnaggcccattccacaaagcccatctctggtntgagaattccttttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataattagtg

SEQ ID NO: 28524 - DNA, 100 bp, Homo sapiens
  misc_feature 66, 83, 88: n = A,T,C or G
ataagaaaaaagggaaaaaatgccagatgtaaatctatatcagtaataatattatatatgaatggntttaaaaagtgttaatntattnaataatccagtc

SEQ ID NO: 28525 - DNA, 317 bp, Homo sapiens
catggcgaccaacatccgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagacgcgtatctgtacaaacagatcctactgatgaaattcccact

SEQ ID NO: 28526 - DNA, 216 bp, Homo sapiens
tgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatg

SEQ ID NO: 28527 - DNA, 387 bp, Homo sapiens
  misc_feature 52: n = A,T,C or G
aagaaagcatcctctgccaagtttcaaaaggaaagaaagaaaaaagggccanaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagcttgacctgacacagattgatgtcaacgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccat

SEQ ID NO: 28528 - DNA, 396 bp, Homo sapiens
  misc_feature 19, 20, 45, 70: n = A,T,C or G
tatggcccgggaactttcnnaatttggataaatgggccgggtgtngtggctcacacctgtaatcccagcntgttgggaggctgaggtgggaggactgcttgagcccaggagttcaaaaccagcccgggcaacatagcaagatcccatctcaattaaaaaaaaatttttttttaaataaatagaagctatagcagctagggaaatcagtaaggagacatttgatgtctactacaatctcaagagcaatctctaaaagatatgattctaagaattattatggtacaatgacaaaaatgacaataattgtatgataaaagcagttccattttgggatgttttctatgtacctaaccactttatgtacattttctcatttaatccttacaacaatcttac

SEQ ID NO: 28529 - DNA, 311 bp, Homo sapiens
aatttgtcaagaaaggccttatccatttcgattgtgtgacagattgaaatttattgtttacattggggaatgtatctcaaatttttaaatagaagagtaataaacagactttaaagcaaatattaagatctttactcactcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtat

SEQ ID NO: 28530 - DNA, 266 bp, Homo sapiens
cagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcagcttggacagcaacagggacaacgaggtggacttccaagagtactg

SEQ ID NO: 28531 - DNA, 200 bp, Homo sapiens
gaacagaacttcatcctgttggctgtggggagccactaagaagttcaagcctgagagtgtcagatggatatgttagtgttagatggactacttggcagcagtatagaggagaagcattcttaatctttataagcctcaattgctttttctgcttaatgagctaatactaatgtctgcccaactatttgtatggttttgtg

SEQ ID NO: 28532 - DNA, 100 bp, Homo sapiens
  misc_feature 72, 92, 93: n = A,T,C or G
caagcgatcctcctgcctcagcctcctgagtggctaggatgataggtgtgtgccaccacaccaggctaattntttaaatttttaaaattatnnttttgag

SEQ ID NO: 28533 - DNA, 193 bp, Homo sapiens
aaattcacacacaaaacccatcattcctcatgcccaataacatgcctatgcaacttatctttgttgatctgtatgtttaatgatatttccatttcattttgattgagattacatatctaataatatcttaaggagctgagttgataagcatttaagaaatgtaatttgagaaggtatgggctttctcaatcac

SEQ ID NO: 28534 - DNA, 279 bp, Homo sapiens
  misc_feature 2: n = A,T,C or G
gngaaatgacataatgaaatgacccaatggaataatgacaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgatgagatgaaatgatgagatgaactg

SEQ ID NO: 28535 - DNA, 264 bp, Homo sapiens
  misc_feature 8, 22, 34, 151: n = A,T,C or G
tataaacngcgaggcactggcncagcgtccatgnaattaagaggggtttcctgtcttagttctctcttgtatatgctgaaaaaccaaagcagagtgaggaacaaggactaggtggagaaagcaaggccgaacatggaagcttttctacagntacttctgtgaaagtaactataatttgaaactggattaaattttcccttccccttctccttctcattgctgtactagtattacaaaaagaagctgtgagaaacatctaaaaga

SEQ ID NO: 28536 - DNA, 396 bp, Homo sapiens
  misc_feature 3, 5, 27, 28: n = A,T,C or G
ganancaacactgtgttatattctttnnttcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaaga

SEQ ID NO: 28537 - DNA, 442 bp, Homo sapiens
  misc_feature 3, 4, 26, 434: n = A,T,C or G
cgnnacttatggccaggatgaaacanagtcgacagtttacaaggtttcatttgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcnctgaaaag

SEQ ID NO: 28538 - DNA, 204 bp, Homo sapiens
gttgatgtttattacatagtacccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgac

SEQ ID NO: 28539 - DNA, 380 bp, Homo sapiens
  misc_feature 8: n = A,T,C or G
atggagcnaacgacacaggttaggagacgtttttttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaat

SEQ ID NO: 28540 - DNA, 349 bp, Homo sapiens
tctctccatcagtgattgcccagcaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagtcaatggcattgtgaagcacttccataagcctgagaaagagcgaggcagtctgacgctgttgctctgtggaga

SEQ ID NO: 28541 - DNA, 343 bp, Homo sapiens
  misc_feature 4, 31, 33: n = A,T,C or G
agancccccgaattaataccaatagaagggntntgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacacagacgaaaatggaaagattaattgggagtggtaggatgaaacaatttggagaagatagaagtttgaagtggaaaactggaagacagaagtacgggaaggcgaagaaaagaatagagaagata

SEQ ID NO: 28542 - DNA, 169 bp, Homo sapiens
  misc_feature 3, 7, 30, 43, 140, 141, 146: n = A,T,C or G
aanctgnttctcccaaaaaccgtgttaatnggaagtggttgcnatctggattcagcccgattccgttacctgatgggggaaaggctgggagttcacccattaagctgtcatgggtgggtccttggggaacatggagatgnnggggngcctgtatggagtggaatgaatg

SEQ ID NO: 28543 - DNA, 256 bp, Homo sapiens
tggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttct

SEQ ID NO: 28544 - DNA, 186 bp, Homo sapiens
tggtaaactccatctaaggctaaataccggcacgagaccgatagtcaacaagtaccgtaagggaaagttgaaaagaactttgaagagagagttcaagagggcgattatgtgctggctgtgaagtggggggaggaacacatccctggcagcccttttcatgtcacagtgccttaaaacagttttctc

SEQ ID NO: 28545 - DNA, 342 bp, Homo sapiens
  misc_feature 12, 21, 29, 37, 39, 44, 68, 248, 250, 251: n = A,T,C or G
taacggggccgngaaacccgncttattgnggccgggnanaaccnctattattattacatagtgtcttntttaaaatacccttggttgctctgacatggctgagactaatgagaagggttaatctgttggattttatccagaactaaggatttgagacataatgcacaaatggtttactttttttcttaatggagcaagagatatatttgtttattccttcccctgaaaaaacagaaacaaaacttccncnngattctgtaatgcagaagcattgtcactcattttgaatagtcttaatattttcttatataatctctacaaatatgtctgaggagcaaatac

SEQ ID NO: 28546 - DNA, 320 bp, Homo sapiens
  misc_feature 8, 34, 38, 41, 42, 216, 283: n = A,T,C or G
gagcatcnaccatgctcacttctaggaaatactntttntanngctcacacctcatatacctccctactatgcctagaaggaataatactatcgctgttcattatagctactctcataaccctcaacacccactccctcttagccaatattgtgcctattgccatactagtctttgccgcctgcgaagcagcggtgggcctagccctactagtctgnggctccaacacatatggcctagactacgtacataacctaaacctactccaatgctaaaactaatcgncccaacaattatattactaccactgacatgactttcc

SEQ ID NO: 28547 - DNA, 352 bp, Homo sapiens
  misc_feature 176, 178: n = A,T,C or G
ctttggtaggccagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgngnggcatcgacccagttgtagccagatcagtttatcacctagaagacattgtcagacagaagaaaagacttgaacaagataaatcccagaccaaagagagtctacagtatgcattagaaaccttgactatgaatggctgctcagttgagaatctaggactggatttcactctgcca

SEQ ID NO: 28548 - DNA, 322 bp, Homo sapiens
  misc_feature 21, 177: n = A,T,C or G
gtgaagcggcagctgaggagnctccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctatngggaacgacagggattgtcaatgaggcagatcagattccgatttgacgggcaaccaatcaatgaaacagacacacctgcacagttggaaatggaggatgaagatacaattgatgtgttccaacagcagacgggaggtgtctactg

SEQ ID NO: 28549 - DNA, 280 bp, Homo sapiens
  misc_feature 2, 180: n = A,T,C or G
cnacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggncaaggtgtagcccatgaggtggcaagaaatgggctacattttctaccccagaaaactacgatagcccttatgaaacttaagggtcgaaggtggatttagc

SEQ ID NO: 28550 - DNA, 109 bp, Homo sapiens
  misc_feature 4, 5, 17: n = A,T,C or G
gacnncactgccttggngtgtgacaatggctctgggctctgtaaggccggctttgctggggacgatgctcccagggctgttttcccatccattgtgggacgtcccagac

SEQ ID NO: 28551 - DNA, 325 bp, Homo sapiens
  misc_feature 24, 181: n = A,T,C or G
caagctgcagatccaggcttttcngggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacaggggggnccagcagcagctccacctactgtaaccaaatgatgaggcgccggaatatgacacaggggcggtgcaaaccagtgaacatctttgtgcacgagcccctggtagatgtccagaatgtctgtttccaggaaaaggtcacctgcaaga

SEQ ID NO: 28552 - DNA, 275 bp, Homo sapiens
  misc_feature 25, 177: n = A,T,C or G
acccagtacctcagttggaaatgcngaaatcattcgtcttccacgtcgctcactctgggagctatagactggagctgttccaattcggacatcttggaaccctgatatgatattcttttagtaattgtgtgtgtgttgaactcttctgttgtaattttatgaataattaaataagtntcaaatataaaaatcataaatgattccattaatttagttggaaatcataataaaaaatttattatatatttaagaaaagatatacacttttcttatat

SEQ ID NO: 28553 - DNA, 197 bp, Homo sapiens
  misc_feature 178, 188, 196: n = A,T,C or G
tggaatattatccaggagaaacttccccaacccagcaagtcaggccaacattcaaattcaggaaatacagagaacgccacaaagatactcctcgagaagagcaactccaacacacataattgtcagattcaccaaagttgcaatgaaggaaaaaatgttaagggcagccagagagaanggggggggtncccacaang

SEQ ID NO: 28554 - DNA, 129 bp, Homo sapiens
cacagatgtgcacggaggccacaccacactgacatttggaattccttcagggtaaaaggacaccggaatgggagcttagaagtgtgttgctaagatttccggctgcacggaattattaagtttttctta

SEQ ID NO: 28555 - DNA, 277 bp, Homo sapiens
  misc_feature 5, 7, 161, 164, 277: n = A,T,C or G
aattncnttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagnggnggagaaatacttttccattgtttaactgcaaaacaagatgttaaggtatgcttcaaaaattttgtaaattgtttattttaaacttatctgtttgtaaattgtaactgattaan

SEQ ID NO: 28556 - DNA, 185 bp, Homo sapiens
  misc_feature 185: n = A,T,C or G
ctgagggggcaggcggagcttgacgaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagagggagn

SEQ ID NO: 28557 - DNA, 221 bp, Homo sapiens
  misc_feature 15, 167, 173: n = A,T,C or G
cccttggaagtttanccgtatgtttgactaacaaaaattccctacatcagagactctaggtgctatataatccaaaaacttttcagcctgttgctcattctgtcccatgctggcaataataccttgtcagcccattacccttattttgaattgctccatctcctggngggacntgtatcttgtctgccatatcagaacacaaacccctgaagaggttctga

SEQ ID NO: 28558 - DNA, 364 bp, Homo sapiens
  misc_feature 143: n = A,T,C or G
atttcagctgtaaatagttaagactgtattctctaagcgaaaggaaaagttgtgataaagaagcaccgttttttttctggaagtgctggaacgctttggatattaatataatttttctgagtaatcatgttaataactatggnatgtgaaataattcctgcagtagctgactgcttagccttctggaactgaactgaacgcattatgtgagctctcttggtaatgaaggtcgcaaatcaaaggaaagaatacatgaaaaaaggattagaacaaaaagagataaagccataaccctacatccctgttataatgaatcctgtaatttgacgagtgtaagcgggtaaaaaatggcatttaatgaatt

SEQ ID NO: 28559 - DNA, 124 bp, Homo sapiens
cgatgaagaacgcagctagctgcgagaattaatgtgaattgcaggacacattgatcatcgacacttcgaacgcacttgcggccccgggttcctcccggggctacgcctgtctgagcgtcgctcg

SEQ ID NO: 28560 - DNA, 312 bp, Homo sapiens
  misc_feature 174, 177: n = A,T,C or G
aacatgcctctcgcaaaggatccccttcatccctctccagaagaggagaagaggaaacacaagaagaaacgcctggtgcagagccccaatccctacttcatggatgtgaaatgcccaggatgctataaaatcaccacggtctttagccatgcacaaacggtagttttgtgtgtnggngggtccactgtcctctgccagcctacaggaggaaaagcaaggcttacagaaggatgttccttcaggaggaagcagcactaaaagcactctgagtcaagatgagtgggaaaccatctcaataaacacattttgggc

SEQ ID NO: 28561 - DNA, 375 bp, Homo sapiens
  misc_feature 24, 177, 374: n = A,T,C or G
tgcttcaacagtgtttggacggancagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctnggagattcgtcagaattattccaccgacgtggaggcagccgtcaacagcctggtcaatttgtacctgcaggcctcctacacctacctctctctgggcttctatttcgaccgcgatgatgtggctctggaaggcgtgagccactttcttccgcgaactggccgaggagaagcgcgagggctacaagcgtctcctgaana

SEQ ID NO: 28562 - DNA, 147 bp, Homo sapiens
  misc_feature 37, 77, 81, 118: n = A,T,C or G
aggggatcctcctgctttggcctcacaaagtgctgtnattacaggcatgagccactgcgcctggccaacaacctttntttntatggaattataaggctgactttaggatatttcaggnttaatagaatcatcatcatcatttaagta

SEQ ID NO: 28563 - DNA, 316 bp, Homo sapiens
  misc_feature 2, 181, 182: n = A,T,C or G
gntttggttactatagctttgtacccaagttttgaagtttgataaagtgatgcctttagctttgcttattttgctcaaagttatttgtctattcagagttttttgtggatccacgtaaatttaaaatatttttttctatttctgtgaaaaaatgtcattgatattttgataaaaatcacgnnagtctctagatcactttgggtagctatattaacagtattcttccagtgtataaacacaagattttttcatttattcatttgtattttatattttttatccatgttttgtcattttcagagtagagatcttgtac

SEQ ID NO: 28564 - DNA, 379 bp, Homo sapiens
  misc_feature 25, 181, 184: n = A,T,C or G
taaaactcctgacctcaagtgagcngcctgccttgttctcccaaagtgctgggattataggtgtgagccaccacacccagcccaaaagtaatttctttggactcttccttacctcatcagagaggagctgctactttgttgccacagactgtcctcagagagcctttgatcctgtctctgntgntccctgtgctgcaacctgggctttcagcaggcgaaagacacagcagacctgcccatagctgtgggcagtccggcttggcttgttaccaagagatttactcagcttgctttgaagagcttgtgtcgcccagtgaggaaccctgtgggcttctccttccactctgtgttgccagtggcctacatctgagctgcccat

SEQ ID NO: 28565 - DNA, 345 bp, Homo sapiens
gctctaagggggctggcaacatggctcagcaggcttgccccagagccatggcaaagaatggacttgtaatttgcatcctggtgatcaccttactcctggaccagaccaccagccacacatccagattaaaagccaggaagcacagcaaacgtcgagtgagaggtaatggggcttctcaatcaagcaaaattctaggcttagacagtgtggggaggtgctggacaatgttaattttcaaactcctccaggagactatcttcggtgatggcaccatgccatcatccctatatggcatttcaggggattaagtgaacttgtaatgctctgggatagtttattttaaag

SEQ ID NO: 28566 - DNA, 147 bp, Homo sapiens
tctaaatccccttgtaaatccaactgttagtccaaagaggaacagctctttggacactaggaaaaaaccttgtagagagagtaaaaaatttaacacccatagtaggcctaaaagcagccaccaattaagaaagcgttcaagctcaac

SEQ ID NO: 28567 - DNA, 384 bp, Homo sapiens
  misc_feature 3, 14, 28, 37, 126, 176, 222, 267, 345, 347: n = A,T,C or G
agngaactgttctnctaaagactccttntttctgcancatggggaagaacaaactccttcatccaagtctggttcttctcctcttggtcctcctgcccacagacgcctcagtctctggaaaaccgngagtgccacacagagagcgtgaagcatgaacctagagtccttcatttatngcggatttttctttatatcattcctttttctttcctatgatactgncatcttcttatctctaagattccttccagattttacaaatctagnttactcattacttgcttacttttaatcattcttccccaactctctgaagctctaatatgcaaagccttcctaaggggngncagaaatttttagctttttaaaagaataaattttaga

SEQ ID NO: 28568 - DNA, 283 bp, Homo sapiens
  misc_feature 22, 174, 180, 267: n = A,T,C or G
caatagcaggttcacgtacacncccctgaaggatggctgcacgaaacataccggtaagtggggcaagactgttatcgagtaccggtcacagaagacctcacgcctccccatcattgacattgcacccatggacatgggagggcccgagcaggaattcggtgtggacatagggcngggggngcttcttgtaaaaacctgaacccagaaacaacacaatccggtgcaaacccaaaggacccaagtactttccaatctcagtcactctangactctgcactgaatg

SEQ ID NO: 28569 - DNA, 273 bp, Homo sapiens
  misc_feature 163: n = A,T,C or G
tctaagttgtgtttattcctggaccgacatgccaccccgaatggctcactttcactgaggatgctgtcctctgatttagctgctgcctccagcctctggcttgagaacttactaaaggcacttccttcctgttaaacccctgttaactctccataaatttggngattctctgctaggcctaagattttgagttaacatctcttgaagccaaactccaccttctgtgctttttgcttgggataatggagtttttctttagaaacagtgccaaga

SEQ ID NO: 28570 - DNA, 157 bp, Homo sapiens
  misc_feature 24: n = A,T,C or G
tgcagcgtcaccaggtgatcaccnggtgatcggcgtttgtcagccccattagaatcttacaggaccatcatcgtaggtacagtttgttgttgactgaaatgttatgtggcccatggctgtagttacgtccagtagtatgctggtaaatccactctca

SEQ ID NO: 28571 - DNA, 182 bp, Homo sapiens
  misc_feature 181: n = A,T,C or G
cggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagaggng

SEQ ID NO: 28572 - DNA, 157 bp, Homo sapiens
  misc_feature 2, 22: n = A,T,C or G
gngctgagattacaggcgtganccaccgcacccagcctccttttcatatttcactcatttccactgcagtgagtttagggattagaccagtaaggaaattagttctttttgcttacagacaacagaaatagaagaaaacaaactagaaattagctcc

SEQ ID NO: 28573 - DNA, 224 bp, Homo sapiens
  misc_feature 179, 180, 222: n = A,T,C or G
tgaaaccccgtctctactaaaaacacaaaaaaattagccaggtgtggtgggtggtgcctgtagtcccagctactcgggaggctgaggcaggagaatggcgtgaacccgggaggcggaggttgcagtgagccgagatggcaccactgcactccagcctgggcaacagagcgagactccgnntcaaaataaataaataaataaataaataaataaataaataantg

SEQ ID NO: 28574 - DNA, 205 bp, Homo sapiens
  misc_feature 24, 25, 182: n = A,T,C or G
aaatggaactagaaaaggcagaanncggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagnaaaagctgctggagacactactg

SEQ ID NO: 28575 - DNA, 123 bp, Homo sapiens
  misc_feature 20: n = A,T,C or G
tcaacatttattagattggnagatttctatcaatctgatatttatttatttaattaattagattaacaataacagttatgacagtctggttttctttaaaataaatactatcacatagaagat

SEQ ID NO: 28576 - DNA, 147 bp, Homo sapiens
  misc_feature 20, 24: n = A,T,C or G
actatactgacgaagccatngaancagatgatctgaccattaagctggtgatcaaggcactcctggaagtggttcagtcaggtggcaaaaacattgaacttgctgtcatgaggcgagatcaatccctcaagattttaaatcctgaag

SEQ ID NO: 28577 - DNA, 118 bp, Homo sapiens
  misc_feature 26: n = A,T,C or G
acggggaagaccatcaccctcgaggntgaaccctcggatacgatagaaaatgtaaaggccaagatccaggataaggaaggaattcctcctgatcagcagagactgatctttgctggca

SEQ ID NO: 28578 - DNA, 104 bp, Homo sapiens
tataactaatataataggacaatcctcaatgcatatatagccagcccttcatatctgtgggttttgcatccatggattcaaccaaggaggaattgaaaacactg

SEQ ID NO: 28579 - DNA, 177 bp, Homo sapiens
  misc_feature 2, 24, 174: n = A,T,C or G
tnaccttactgaatactgtaggcngttataacagtatggtaaatatttgtgtatctaaacaaagaaaagatacagtagaaatatggcattataatcttatgggggccaggcagggtggctcacacctatgatcccaaagtgctgagattacaggcgtgagccaccgtgcctggntgg

SEQ ID NO: 28580 - DNA, 149 bp, Homo sapiens
  misc_feature 21, 23: n = A,T,C or G
agtcaacttctcagaagtttncnaagaagtgctcagagaggtggaagaccttgtctgctaaagagaaaggaaaatttgaagatatggcaaaagcggacaaggcccgttatgaaagagaaatgaaaacctatatccctcccaaaggggag

SEQ ID NO: 28581 - DNA, 212 bp, Homo sapiens
  misc_feature 1, 21, 177, 179, 180: n = A,T,C or G
ntatagcaatgatgtttatanccacagaaaaactggaaactactacgcagccatatactagaaagtatgatatatacaaacatcattttataatgagatatgaattttatatatatacatatatatgttcataaatataaaaatggatacttctggttaaagatgatggggtaaagngnnttttactccatcccctttctcaaaacattcac

SEQ ID NO: 28582 - DNA, 137 bp, Homo sapiens
  misc_feature 22: n = A,T,C or G
gccactcactgccttgaacctnccccctcactccaggactgccagaggaagcaatcaccaaaatgaagactgctttaattttgctcagcattttgggaatggcctgtgctttctcaatgaaaaatttgcatcgaaga

SEQ ID NO: 28583 - DNA, 185 bp, Homo sapiens
  misc_feature 5, 176, 180, 184: n = A,T,C or G
taggngaaataatgaaatgagaccaaataacgaaataaaattgaaatgagatgagaggaaatgagatgaaatgttgaaaagaaaggaggaaatgatgaggtgagatgaaatgatgagatgaaatgaattgagatgaaatgagatgaaaaatgatacgaaaaatgatataaaaaatntggngggng

SEQ ID NO: 28584 - DNA, 249 bp, Homo sapiens
cacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacatt

SEQ ID NO: 28585 - DNA, 410 bp, Homo sapiens
gtttttttgttttgttttatttgttttgttttgttttaacatctctgtttccttcccctttctgttgttgctccttcctcctcccactccaactaccacacaaatcctgacaggagcctttctgcccctctagggaaggggcccgtgtgaggaactcttactggacgcccccttccctgttgctgtgctgatcttacacatcagtttccacggatcccatgtgaatcagttgtcttcctcatttactctgagcaagggtggcagcagcaatagcagaagacgtagatgcagtgactcattttgcatgatgtctgcaagagagccgggcctcccgtgtgctgtggctctcgttcaggcattgcttcagaaacttgattcttctggaattgtgcataagagggccttttaga

SEQ ID NO: 28586 - DNA, 473 bp, Homo sapiens
agaataggaatatacgtttttatatgaaccatgactgcagatagttatatgatattgaacaatattatgaaacgtcttttcacactctggaactttttgttattcactgatagggagagtgccaacaatttcacagaatcagtttttcctgcttttgtgtcttctgtatcttcacaaagattttttttccatgcaacagcaagttgatgtagaatgtacagaagaaagtttaataaatttcagggcatttgcagtactctttgaacaaatagtatttatccttttgttggatgaatgaatgaccacacaatcagcaaaacacctgaccacatatttactgagtaccttatgtgtatgaggcattgttttagacactgttagatgcaaggtttcagtcaggccagtaatttcagtccttaagttgcttaccatccaagagagccaataatgatcaaacaaggtggaaaaaggtc

SEQ ID NO: 28587 - DNA, 452 bp, Homo sapiens
  misc_feature 120: n = A,T,C or G
ggccccaaaatggtggtgttcgggtatgaggctgggactaagccaagggattcaggtgtggtgccggtgggaactgaggaagcgcccaaggttttcaagatggcagcatctatgcatggncagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaatttgatgctttgtattcagataatataagcaaggaaaactgtgttttcagaagctcactgattg

SEQ ID NO: 28588 - DNA, 393 bp, Homo sapiens
gtagcaaagggaaggtttaggtccagtttgtgcagcacgtttggctgacacgtcctgtgtggatttcaacatgttcctttccctcatatgccacccacagagatcaccctaagacacttttcaggcttcagaggttggaaactaaaattccattggtacatatctgataaactggtgcaagattgtcctgtttttctgccagagctctagcaaagggggtttgtcagacatcccagaggcgctgctgttggctttctatttagcaatttggaaatcctaaatctaagtagattcagtgaacccaaccctaggacactgagaaaatcattaaagagctccaatttgcatgtatcatttagccacacctcattttggatatgattctttgtatga

SEQ ID NO: 28589 - DNA, 161 bp, Homo sapiens
cgactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcc

SEQ ID NO: 28590 - DNA, 146 bp, Homo sapiens
  misc_feature 1, 6, 8, 11, 13, 27, 28, 31, 51, 56, 74, 76: n = A,T,C or G
ngatgntngtngncgtgcctaccatgnngancacgggtgacggggaatcanggttngattccggagagggagcntnagaaacggctaccacatccaaggaaggcagcaggcgcgcaaattacccactcccgacccggggaggtagt

SEQ ID NO: 28591 - DNA, 474 bp, Homo sapiens
  misc_feature 44, 103, 147: n = A,T,C or G
atttatggcctcctgctgcattctcctacctcaaggacacagcnagtgcacaaggctgcctacctctctcccaactccactgttgctgtgctgttggcttcgncacactgcctgccctcctcaaactttctgaacctcagcttgttngctttccagatcaaatccctgttcctagttttttctgctgcccatcagataggtctctagactagctctgttctctcccaggaaggaactgagagtccagcttccccctcctccccaaacacagtgttgagcataacagatcctctccccacaggaatgggggagtgacccgcttgacctttgaatatgactctgaaccctttgggaaagaacgggatgcagccatcatgaagatggccaaggaggctggtgttggaagtagtgacgggagaattctcataccctctatgacctggacaggtaagagatggggcccagggatcaggt

SEQ ID NO: 28592 - DNA, 471 bp, Homo sapiens
  misc_feature 471: n = A,T,C or G
caagcaattaatcccaagttgcttcagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagatatgtn

SEQ ID NO: 28593 - DNA, 390 bp, Homo sapiens
ggaaactgaacaacctgctcctgaatgactactgggtacataaataaatgaaggcagaaataaagatgttctttgaaaccaacgagaacaaagacacaacataccagaatctctgggacacattcaaagcagtgtgtagagggaaatttatagcactaaaagcccacaagagaaagcaggaaagatccaaaattgacaccctaacatcacaattgaaagaactagaaaagcaagagcaaacacattcaaaagctagcagagggcaagaaataactaaaatcagagcagaactgaaggaaatagagacacaaaaaaccctttaaaaagttaatgaatccaggagctggttttttgaaaggatcagcaaaattgatagaccgctagcaagac

SEQ ID NO: 28594 - DNA, 474 bp, Homo sapiens
  misc_feature 5, 24, 92, 97, 128: n = A,T,C or G
ggatnccactgagccccctacagncgaacagatatgaggaaattgttaaggaagtcagcacttacattaagaaaattggctacaaccccganacagnagcatttgtgccaatttctggttggaatggngacaacggtgctggagccaagtgctaacatgccttggttcaagggatggaaagtcacccgtaaggatggcaatgccagtggaaccacgctgcttgaggctctggactgcatcctaccaccaactcgtccaactgacaagcccctttgcgccttgcctctccaggatgtctacaaaattggtggtattggtactgttcctgttggccgagtggagactggtgttctcaaacccggtatgggtggtcacctttgctccagtcaacgttacaacggaagtaaaatctgtcgaaatgcaccatgaagctttgagtgaagctcttcctggggacaatgtgggcttcaatgt

SEQ ID NO: 28595 - DNA, 181 bp, Homo sapiens
  misc_feature 12, 13, 47, 50, 56, 62, 68, 143: n = A,T,C or G
aatttccggccnntctattggcgcgggcgatggtagtcgcacgtgcntanccatgntgaccnacgggngacggggaatcagggttctgattccggagagggagcctgagaaacggctaccacatccaaggaaggcagcaggcncgcaaattaccccactcccgacccggggaggtagtgac

SEQ ID NO: 28596 - DNA, 498 bp, Homo sapiens
  misc_feature 3, 18, 33, 51, 62, 454: n = A,T,C or G
ccngggaatctccggccntctatggcgcggggnaatgccttggaatacccnaatcccgtganctacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtattgtttttattactgggttaatggagtaatggnacttttattctttcttgatagaaacctgcttacatttaaccaag

SEQ ID NO: 28597 - DNA, 500 bp, Homo sapiens
  misc_feature 10, 17, 46, 75, 86, 90, 110, 141, 186, 217, 220: n = A,T,C or G
acccgggaancccggcntctttggcccggggagtcctggctggagnagcgagtctgtcgatccccaggccagagnccaaggcagancaanggttcctttgtaaagaagcncctttccagcaccctccttctctttcttccnttttgcccaaaacttcaccccagtgagtgtgagcattttaaagangcatccctctgccaagaccaaaaggaaaganganaaagggccaaaagccaaaatgaaactgatggtaccttgttttcacccattgggctaactttgctgctaggagttcaagccatgcctgcaaatcgcctctcttgctacagaaagatacctaaaagatcacaactgtcacaaccttccggaaggagtagcttgacctgacacagattgatgtcaatgtccaggatcattttctgggatgggaagggattgtgaagatgatctgttactgcaacttcagcgaattgctctgctgcccaaaagacgttttcttt

SEQ ID NO: 28598 - DNA, 474 bp, Homo sapiens
tctttaaaataaaaatgataaaggacttatttcagtaccagtgctcagtaaaatttaatgcaatttttaaaaaaatttaatgactttgagaatatactaaaatgtaatttttccagattttgaagaatcctccacagaattcaaattttgtcattacagagcatatcattttatccctttggaactattttctgctggttgctttgtattgctttttcccccaggcatgtaagttgagatcagacctctttcactttatttttaaaaagtatatatccaattattctgtgtcaattaaaaatacttttaaaaattcagcaggctgctgctgcttcagagacacagacctcttttaaaccgtactaaatagattgataggggagaaaatattgaaaatttctacaaattctgaactttaaaagcatagttataaagacaggaacaacagacgggcatatgtgaagggatgagcat

SEQ ID NO: 28599 - DNA, 381 bp, Homo sapiens
attaagattgggctaccctcccacccacttttctcaaggggtttgaccctcagaactgtctgcgatgggcttcctcaggggcaaggtgtttcccttcactggaagtgtttaaacaaaagctgaacagtcattttgtagggatgttatggaagcaatttgaggaccagctgggagtttgaatcagatagggtaaacataacacaaaattttgtttatgagtttcaagaggtcgctgaccctttgaagccatccatagatgccctaaataattaagggcccctagaccagaagttctcaacttcagctgaatgttaccaaccactgggggagatttaaaatgtatttgaagcctgggcaatgtggcgaaccctgtctctacga

SEQ ID NO: 28600 - DNA, 209 bp, Homo sapiens
aagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 28601 - DNA, 460 bp, Homo sapiens
gattgctcagtgtattctcccccaggctggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaaga

SEQ ID NO: 28602 - DNA, 472 bp, Homo sapiens
  misc_feature 470, 471: n = A,T,C or G
aagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagaagaaagggcctgctggtctcatcctctgcttcctttgcctttaccctatacctctctgcacgtcccaccccattttgctgtgtgctcacccccaggatgtgtaccccggttgtagtaggagctgaaatccatgctgagctgtaccaggaacttgcatatctagagacagagactgagtcactggcccatctctttgctcttgtgccccaggccagaataaagaatagagggnng

SEQ ID NO: 28603 - DNA, 230 bp, Homo sapiens
  misc_feature 6, 142, 216: n = A,T,C or G
gaggtnctatgggaattctgtactacagtatcagtatttctctaaattgaaaactattcatggccaggtgcagtggctcatgcctataatcccagcactttgggaggctaaggcgggaggatcacttgagatcaggagttcngagaccagcttggccaacatggcgaaaccccgtctctactaaaaatacagaaattagctggggtgtttttgggngcatgtctgtagtc

SEQ ID NO: 28604 - DNA, 355 bp, Homo sapiens
  misc_feature 1, 25, 63: n = A,T,C or G
nccgcattccctgaaacatggagcnaaagacaaagatgactgaaataacttcaaattccagcnaaacgttccttgttgccacttttgggtattctgagattttctcttgcatgcccttagctttacagcttttgatttcctgttgtatttattctcagccattttgggcatatgtatctttataatcagactggaaacgggactttctattaatatcattttcagaataaaaaataggataatttaacctaccagcccttctcccccaataactgtggtctatacagagtcaatatattttttcagagaaagttattcgctcgattttttctgaatcataattaaactttatgat

SEQ ID NO: 28605 - DNA, 154 bp, Homo sapiens
  misc_feature 27: n = A,T,C or G
caataaagtggttacttcattatatanaaatcatatcactccctaacacaatataatttattgtgtgcttactgtcaaagccattttataaagaaagcgcaatctggaccatattacataaaatacgtgctgttatgttgcctttcatttcatg

SEQ ID NO: 28606 - DNA, 174 bp, Homo sapiens
  misc_feature 6, 19, 28, 34, 35, 39, 42, 48, 52, 71, 81, 84, 123: n = A,T,C or G
tctatnggcccgggaaccnaagaagacntcagannaccnctntaagcnaganccctttctgaaataaaaangttgcttttnaantagtttgtcctaaggtgtttaaaacctgtcaacctttantgtaaggaaaaatttcctggtccaaataaagttgaagtttaagaaaaattg

SEQ ID NO: 28607 - DNA, 472 bp, Homo sapiens
  misc_feature 4, 5, 12, 25, 61, 84, 103, 121, 122, 136, 273: n = A,T,C or G
ggcnncggaggngttcagctgcttnaagatgaagctgaacatctccttcccagccactggntgccagaaactcattgaagtggncgatgaacgcaaacttcgnactttctatgagaagcgnntggccacagaagtngctgctgacgctctgggtgaagaatggaagggttatgtggtccgaatcagtggtgggaacgacaaacaaggtttccccatgaagcagggtgtcttgacccatggccgtgtccgcctgctactgagtaaggggcattnccttgttacagaccaaggagaactggagaaagaaagagaaaatcagttcgtggttgcattgtggatgcaaatctgagcgttctcaacttggttattgtaaaaaaaggagagaaggatattcctggactgactgatactacagggcctcgccgcctgggccccaaaagagctagcagaatccgcaaacttttcaatctct

SEQ ID NO: 28608 - DNA, 294 bp, Homo sapiens
  misc_feature 5, 6, 39, 50, 86: n = A,T,C or G
cggcnnttttggccgggctcttgggggaaggtttttctnagtggaatgcnccaccgataacaagctcccctctccctccttgtgcnctgcccccagtggtgacttacagacaactgtcaccacttactgactgcttgacctgctgccagaactggcctaagcacttgacacacttcgtatcatttaatttttacagcattgcaaggtaggtgtttggatcaattaggggttgttgttgttgttgttgttgttgtttgttgttgtaagcaataaaaactggctctaatggaactt

SEQ ID NO: 28609 - DNA, 453 bp, Homo sapiens
  misc_feature 16, 442: n = A,T,C or G
gaacatagatccagcnggggcttccctaaagcagtgcagcaccggcccagggcatcactagacaggccctaattaagttttttttaaaaagcctgtgtatttattttagaatcatgtttttctgtatattaacttgggggatatcgttaatatttaggatataggatttgaggtcagccatcttcaaaaaagaaaaaaaaattgactcaagaaagtacaagtaaactatacaccttttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttgggtggtggttttttttttnaagccactctc

SEQ ID NO: 28610 - DNA, 365 bp, Homo sapiens
  misc_feature 3, 22: n = A,T,C or G
atnggccggggaatcttagttnactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatct

SEQ ID NO: 28611 - DNA, 116 bp, Homo sapiens
caagttgctgaagaaaatcggttccatcccagcatgctctcaaattacctaaagagcctaaaggttaaaatgggcttgttggtggacctgacaaatacttcaaggttctatgaccg

SEQ ID NO: 28612 - DNA, 341 bp, Homo sapiens
  misc_feature 8, 37: n = A,T,C or G
gtagcccnagatctttagtttattgtctacacttacnaaagtcaaagttagtggaataggccaggcgtggtggctcacacctgtaatcccagcactttgggaggataaggcaggtgaatcatctgaggtcaggagttcgagaccagcctggccaacatggtgaaacactttctctactaaaaatacaacacttagtccggtgcaatggcatgtgcctgtattcccagttactcgggaggctgagacaggagaatcgcttgaacctgagaggtgggaggttgcagtgagccaaaatcatgccactgcacttcagcctgggtggcagagtgagactcccactc

SEQ ID NO: 28613 - DNA, 459 bp, Homo sapiens
  misc_feature 455: n = A,T,C or G
acaatttatgaaagtgcaatttctctcaagtttttttttaaatgtcactctattttaattactatttttggctagcaaatatttgctaaaatttatttgtatcacaattccatttgagttttaaaaatatgatatactataaactatttgtattgcattataaataaaaatagctaatatcatctattaaaatgagcaaataaactatgaaagcaaattctaccaaaataagaaaagtaatttgtaactttggatatccaactatcagtgcctaaaaaatctgctaattttttaaaaggttgtaaagataacaacaaaagttagatgtggcctatgtctttaaattatgcatgagagaggacacaatgccaagatctagcaactgagtattgaaaaaagtaagggatttaatgtaatccaatattagctgaaaagactagaaagtacattcttgnatta

SEQ ID NO: 28614 - DNA, 322 bp, Homo sapiens
  misc_feature 16: n = A,T,C or G
gtgaatgaagagaatnagaaatagcagatgagtttgtggacctggaactagaagaaaaattacaaaatgtagattcctcaagttgatgtttatcagttagcccattctcagatttggaagaggttgaagattcacaatattcctttaaagatcatctagtaatagtcgtcttccccctggagagtttcccagttgtgtggatcatttcctccatgattggctcctgttttgtgctggactgcactcaagcacccatgggtattcttgacagctcttagtcacaccaaataatatcagagtagaaggtaagggaagtatactg

SEQ ID NO: 28615 - DNA, 472 bp, Homo sapiens
ggaacaatgacgccctgcgcaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcat

SEQ ID NO: 28616 - DNA, 154 bp, Homo sapiens
gagaacagttgtggaaaaaaattaaaaataaacaaacaaacaaaaaacagaaaccctaggcactcttaagagaattagaagtgaggaaaagaaaaaataaaatcaacgaaaagcaggaagagttttaactcctggaatcatctgagaaactatt

SEQ ID NO: 28617 - DNA, 448 bp, Homo sapiens
ggacaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaaga

SEQ ID NO: 28618 - DNA, 376 bp, Homo sapiens
  misc_feature 13, 38: n = A,T,C or G
atctatggatgcnagaaggatatggcacaccatttttnagtgctgaaagaagatactgtcaacccagatttctataccaagtgacaatatccttcaggaatgaaggtaaaatcagagtggtcttggatgcaggaaaactaagagaatttgtgagtagcagaccctgaaagagaatgataaaagaaggaaacttggactgtcaggaataaagaaatcacataaattctacatagtctcttccagaaaatagagaacagtttacaactcattttatgaggccagtattatcctgatagcaaaacctaaagatagtatagaaaactgcaggtcaatatccctgaagcacatagacacagaatcctcaacaaaaactagc

SEQ ID NO: 28619 - DNA, 312 bp, Homo sapiens
  misc_feature 8: n = A,T,C or G
tccccagnaaaactacaaaaagcagctatgggagccgggcgtggtggctcaagcctgtaatcccagcactttgggaggctgaggggggtggatcacttgaggtcaggagttcaagaccagcctggccagcatggtgaaaccccttctctactaaaaatacaaaaattagctggggatggtgacaagtgcctgtaatctcacctacttgggaggctgaggcaggagaattgcttgaacccatgaggtggaagttgcaagtgagcccagatcacgctattgcactccagcctgggtgacagagcgagactgtgt

SEQ ID NO: 28620 - DNA, 135 bp, Homo sapiens
aaatgtggtttattcattagtcattgtgctttatgcagtgctactcagagtagcctttccattaactgtttgttaccagccctcaagataaggagcttgtgccaagaatgtctgtcagtacattgcttccttaat

SEQ ID NO: 28621 - DNA, 321 bp, Homo sapiens
ggcatgttttgagcaaagtagagagtagaataaggttgagatcaaaaagctcagcaaggaacagatgaatcagggcctacagaccatgaaaagaagtttagaatttcttcagaatgcaaaaaaaggccattgagcagttttaagtaaggatgtaatgtgatggaattatatgtttaaaaaggtcactagctggctggatgtggtggctcagatccataatcccagcactctgggaggcagaggtgggaggatcagtttagccaaggagtttgagaccagcctgggtaagatgagaccctgtctctacaatttttttttttt

SEQ ID NO: 28622 - DNA, 451 bp, Homo sapiens
  misc_feature 11, 18: n = A,T,C or G
attgttggaancccttcnggccctgtgcgcctttctcatcagcttcttccgagggtgacaggtgaaagacccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctggtaggaaagttttgcttttgttgatctgagccttctatggaaagtttaaatatgtaacgcattcatgaatttccagtgttcagtaaatagcagctatgtgtgtgcaaaataaaagaatgatttcagaatt

SEQ ID NO: 28623 - DNA, 270 bp, Homo sapiens
  misc_feature 65, 111, 134, 181, 203, 216, 220, 237, 256, 258: n = A,T,C or G
agttttgattagaactttgtttcagccacagcagaatcatgtaaacgtaataggatcatgtagcngaaacttaaatctaaccctttagccttctatttaacacaaaaattngaaaaagttaaaaaaaaaaaggngcatgggattttgcttccagctgcgggactctggcaatagggttttnggaagatgtaattttaaaatgngtttgtatgaacngttngtttacatttctttaanaaaaaaaaacactgttttngngtttgcttggag

SEQ ID NO: 28624 - DNA, 256 bp, Homo sapiens
ggtttatgtagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcacga

SEQ ID NO: 28625 - DNA, 474 bp, Homo sapiens
gctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagaagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctca

SEQ ID NO: 28626 - DNA, 662 bp, Homo sapiens
  misc_feature 12, 121, 122, 123, 127, 405, 415, 512, 527, 593, 600, 630,657: n = A,T,C or G
ctaattgtcggngttaacaaaatggattccactgagccaccctacagccagaagagatatgaggaaattgttaaggaagtcagcacttacattaagaaaattggctacaaccccgaacagnnngccntttttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggattgggggcacctttgctncagtcaacgntacaacggaagtaaaatctgtcgaaatgcaccatgaagctttgagtgaagctcttcctggggacaatgtgggcttcaatgtcaaaaatgtgtctgtnaaggatgttcgtcgnggcaacgttgcttggtgacagcaaaaatgacccaccaatggaagcagctggcttcactgctcaagngattatnctgaacattcaggccaaataagcgccggtntgccctgttttttggattgcacacggntacat

SEQ ID NO: 28627 - DNA, 295 bp, Homo sapiens
agcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtg

SEQ ID NO: 28628 - DNA, 205 bp, Homo sapiens
  misc_feature 1: n = A,T,C or G
natggcccgggggccctctgagcctcatagcctgattcagtaacccagtttcatgcctgtgtcattcacacctcacctacttaatactgccatggtgaaaaatgtggaggaaaaatgtatccatgtgtgtctgggaagcatatacacttgtacattttttaatactctgattctgtaacatttctgagttttgttttgttttaca

SEQ ID NO: 28629 - DNA, 216 bp, Homo sapiens
gtgctgaacacccaaatcacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacc

SEQ ID NO: 28630 - DNA, 102 bp, Homo sapiens
caagaagaaggtcaaataaggtggttctttccttgaagggcagcctcctgcccaggccccgtggccctggagcctcaataaagtgtccctttcattgactgg

SEQ ID NO: 28631 - DNA, 365 bp, Homo sapiens
  misc_feature 128: n = A,T,C or G
tgcctcagccttctgagtggatgggactacagacactttttcaaaaatggcaatggtatcaggaattcctcaagcaggcctggtttattgaaaatgaagagcaggaatatgttcaaactggggaaggncatccaaaggtggtcccggatcagcggtgagcccctatcctaccttcaatccatcctcggatgtcactgccttgcataaggccataatggttaaaggtgtggatgaagcaaccatcattgacattctaactaagcgaaacaatgcacagcgtcaacagatcaaagcggcatatctccaggaaacaggaaagcccctggatgaaacactgaagaaagcccttacaggtcaccttgagg

SEQ ID NO: 28632 - DNA, 470 bp, Homo sapiens
aggggaaagaatgagcaagaagtctctatccttgtgaggctttcacaggaggaggtagataataaacaagtaaatactacagaaaagatatttatagattgtgatgactgacatcaagggaataaagaaggtgatgtataataatggagtgtatttgagggtgaagaaagttctctctgtggatgttatttaagctgaggtctggaaaatgagaatgagccagctaagagaagaggaagaatattccttataggaagtagagtaattgagctaagtgtggtggctcacatctgtaatcccagaattttgggatggcaaggctcaagggctgcttgaggccaggagtttgagaccagcctgggcaacacagcaagactctgtctctacaaaataaaaaatgagccattatggtggcaccgtgtcttgtaatcccagctactctggaggctggggtgggaaggatcactttg

SEQ ID NO: 28633 - DNA, 472 bp, Homo sapiens
  misc_feature 21, 29: n = A,T,C or G
gctcccagaacatcacctacnactgcagnaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcacttgaatggctgacctgacctgatgtccattcatcccaccctctcacagttcggacttttctcccctctctttcta

SEQ ID NO: 28634 - DNA, 472 bp, Homo sapiens
  misc_feature 2, 37, 77, 81, 130: n = A,T,C or G
gnaaagaaaagcacctcttggccggtcacggaggctnacgcctgtaatcccagcactttgggaggccgaggcaggcngatnacaaggtcaagcagtatcaggataatcctggccaacatggtgaaacccngtcctctactaaaaatacaaaagttagctgagtatggtggtgcactcctgtagtcccagctacttgggaggctgaggcaggagaattgcttgaacccaggaggtggaggttgcagtgagctgagattgtgccactgcactccagccctgggtgacagagcatgactccgtctcaaaaaataaaaataaaaaataaagacctcttatttatggtgcttttcgtcctactgatgcctacattttcaaatggttgttatcaacagcttgtggaaggctgattgttatgatgggaaaagaagagagctagggtaattacgaggagcacagtcattggaaggaatgt

SEQ ID NO: 28635 - DNA, 316 bp, Homo sapiens
  misc_feature 4: n = A,T,C or G
gacncgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagcttgctgtgcctgatgccaggacagcctgtgctctcagatgtaaaatagagcaacctatataaacctggatt

SEQ ID NO: 28636 - DNA, 160 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccgggactacgcctgtctgagcgtcgcttgcc

SEQ ID NO: 28637 - DNA, 474 bp, Homo sapiens
  misc_feature 22: n = A,T,C or G
gatttaagaagcatcctctgcnaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagacattagattctattaaatt

SEQ ID NO: 28638 - DNA, 310 bp, Homo sapiens
  misc_feature 2, 9: n = A,T,C or G
ancaacgtnactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgc

SEQ ID NO: 28639 - DNA, 168 bp, Homo sapiens
  misc_feature 3: n = A,T,C or G
atnacatgctaagcctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccacccc

SEQ ID NO: 28640 - DNA, 470 bp, Homo sapiens
  misc_feature 4: n = A,T,C or G
agcnttgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatccctttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctcca

SEQ ID NO: 28641 - DNA, 474 bp, Homo sapiens
  misc_feature 413, 417, 457, 473: n = A,T,C or G
ctcgaagtggagccgagtgacaccattgagaatgtaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaaaggatccaagacaaggaaggcatccctcctgaccagcagaaggttgatctttgctgggaaacagcttggaagatggacgcaccctgtctgactacaacatccagaaagagtccaccccttgcaccttggtgcttccgtcttnaganggggggatgcaagaatctttcgtgaagacccttgactggnaagaccattcaccctng

SEQ ID NO: 28642 - DNA, 169 bp, Homo sapiens
ggaatatagatcagataaaacctccgaatgtaatcccagctacttgggagactgagacgggagaatcgcttgaacccaggaggtggaggttgcagtgagcagagatcatgcaactgcactccagcctgggcgacagagcgagactctatttcaaaaaaaaacaaaaaac

SEQ ID NO: 28643 - DNA, 473 bp, Homo sapiens
ctggaatgaagaaatagttccccagatcaaggaggggaaacgtgtactgattgcagcccatggcaacagcctccggggcattgtcaagcatctggagggtatgtatgttttttcagaggcgccctcaaggaaggataaagcagaactgccacaaatcagggacttggtaaaaaggagtctagggaagggctggacatgttaacagctttagagatggtctagattgacttctagtgaaaaaacaccctcaacccttgtttctcaaaatgtgatctgcagaatagtgacagctggaccccctgggagcttgttatacatgcagaacctcaggtctcactccagacctgtttcagaatcggcatctattccccaggtgatttagatacacattaaagattgagaagctcacctctagattggtattgtcaaatgaaactgctagtgaaaatcctccttagcttgccaagcacagt

SEQ ID NO: 28644 - DNA, 300 bp, Homo sapiens
atttgaggaagtacgagcagctcgggatgacttgagctgagatgtgtaatcccagcactttgggaggccaaggcaggtggatcacctgaggtcaggagttcaagaccagtctggccaaagtggtgaaaccccgtctctactaaaaatataaatatgagccaggcgcggtagcgcacccttgtaatcccagctactccggaggctgaggcagcagaatcgcttgaacctaggaggtggaggatgcagtgagctgagatcgtgccattgcactccaggctgggtgacaagagcgaaactccg

SEQ ID NO: 28645 - DNA, 473 bp, Homo sapiens
ggaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcggttggcttcacagtatgactgatgatcctccaacaacaaaaccacttactgctcgtaaattcatttggacgaaccataaattcaacgtgactggcaccccagaacaatatgtaccttattctaccactagaaagaagattcagggagtggatcccaccttcaacaccttacaagtaaagacaatgaagaacagttgaaaca

SEQ ID NO: 28646 - DNA, 472 bp, Homo sapiens
  misc_feature 280: n = A,T,C or G
attctaaatcgtgtagtctatttgggccctcacaaattaaataacagtacaaaacagtactgtgccaagtgagcagtgaaaataggggctagagaagtcaggaggagagcagtcacgtcgtgacagacctgttaattgctggaaatgtttggtttgatgagggttagtgagcagatggtccagtatctcccaggtgtctgtttgtaatcatcccctgctcctccctcttcagtcacctcccagcccatacacacacacacacacacacacacgcgccttnctttgtgtttaccacaggtgtcaacctacccattcaccatctccctgccacacttttgcacagggaggaggagaccagaactttgtgatacccacaagcatcttcatcataccccagagttcacatgcatgcggtgggcagcttgtgccttgtgagcagcagtcagtaaacaggtgcttggagcctaacctg

SEQ ID NO: 28647 - DNA, 451 bp, Homo sapiens
atagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccac

SEQ ID NO: 28648 - DNA, 240 bp, Homo sapiens
  misc_feature 16: n = A,T,C or G
caggcaaatttcaagncaccttacccctaccccatcccactctgcccatctctaactgcgctggtctgaacccgcacaaatgtctgtgtagtttctgcacttcataacagcttatatgacagttgctccagccattctgtgaacccctgaggggaagggccaggtcttgctagtcattttatttctaatgtctatcatctggtagatgtttaataaatgctaagttgaataattctatct

SEQ ID NO: 28649 - DNA, 319 bp, Homo sapiens
aggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagag

SEQ ID NO: 28650 - DNA, 337 bp, Homo sapiens
  misc_feature 131, 135: n = A,T,C or G
atgataggatttcctaaagtatttgtggacagcttaaatgctaattatatacatctgtagttattctacattttcttgaaatttgagaggttaataccaagtattcatttcatgatgtaaagcaaactgancagngaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaat

SEQ ID NO: 28651 - DNA, 295 bp, Homo sapiens
  misc_feature 23: n = A,T,C or G
gggtgcggaggtcagggacaagnatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgcgt

SEQ ID NO: 28652 - DNA, 223 bp, Homo sapiens
gtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtcc

SEQ ID NO: 28653 - DNA, 180 bp, Homo sapiens
gtgctgaggttattgaagttatacaaaacacatctcagtctctgtttcttggaaaggtatctattacatcctgctagctgactgacaaaactaagcagggagaataaagataattgtattttatgttttgcacacaaacgcagaatttgtataaccatatgacttcatagttgtgatctc

SEQ ID NO: 28654 - DNA, 175 bp, Homo sapiens
tggcgatgatgtaagaaaactgagagaaatgaaagaaatgaagaattactgctgcagataatatacagccttgaggaaagaaaggcttttaagattatagatataaaggctattgctgtattctgggataaaagaaagtctgatgcagggaaaggggaagttggaaaaactggat

SEQ ID NO: 28655 - DNA, 171 bp, Homo sapiens
gtacgactcttagacggtggatcactcggctcgtgcgtcgatgaagaacgcagctagctgcgagaattaatgtgaattgcgggacacattgatcatcgacacttcgaacgcacttgcggccccgggttcctcccggggctacgcctgtctgagcgtcgcttgccgatcagg

SEQ ID NO: 28656 - DNA, 466 bp, Homo sapiens
ggctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgtt

SEQ ID NO: 28657 - DNA, 402 bp, Homo sapiens
  misc_feature 30, 74: n = A,T,C or G
atatgaagctattataatggttttagagtncactggagaaagtacatttaagatgattttggatttattaaagnccctttggaagtcttctaccattactgtagaccaaatgaaaagaggttatgagagaatttacaatgaaattctggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagttttttttttttt

SEQ ID NO: 28658 - DNA, 473 bp, Homo sapiens
aagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcat

SEQ ID NO: 28659 - DNA, 181 bp, Homo sapiens
  misc_feature 8, 20: n = A,T,C or G
caaaaagnagaaactacagnaaactcagatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaag

SEQ ID NO: 28660 - DNA, 469 bp, Homo sapiens
  misc_feature 25: n = A,T,C or G
aaggaagaggagttgtacgcatgtnagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcaca

SEQ ID NO: 28661 - DNA, 300 bp, Homo sapiens
gaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaaccta

SEQ ID NO: 28662 - DNA, 174 bp, Homo sapiens
  misc_feature 23: n = A,T,C or G
gtccttgaattgtctaacctggnacataaacagttgtctcccttctactgtgtagaatactttgacttaattttcttccagatacagggggatacctgcctgtttttcaaagtgtttatttactgctgttactatttgattagaatgtattaaataaaaaaaacctgatttcga

SEQ ID NO: 28663 - DNA, 110 bp, Homo sapiens
cactgtggctcatgcctgtggtctcaacgctttgagaggccaaggtgggaggatcacttgagtccaggagtctgagaccagcctggacaacatgacgaaaccctgtttcg

SEQ ID NO: 28664 - DNA, 117 bp, Homo sapiens
cttttttgcgtgtggcagttttaagttattagtttttaaaatcagtactttttaatggaaacaacttgaccaaaaatttgtcacagaatttcgagacccattaaaaaagttaaatga

SEQ ID NO: 28665 - DNA, 183 bp, Homo sapiens
  misc_feature 11, 17: n = A,T,C or G
atagacaattnaatgtnactgctggccccgtcttcatactctatggataaaacagaaattccagtcctgtaacttacctctgtagcgtcaataacgtgggaaatgatccaaaagggtcttgtagaaagaagactttttacataaacagaaagctgtgatttttgtgggaaacaaacctaccac

SEQ ID NO: 28666 - DNA, 241 bp, Homo sapiens
cattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttct

SEQ ID NO: 28667 - DNA, 476 bp, Homo sapiens
  misc_feature 3: n = A,T,C or G
gtnaacaacatgcaacagtgtcaggtgccttgcaggaaaaataatctgagtcccaagctagcctgtgctcatccacaatcacaatgaacatgtcaaggaagaatttgcagagactcaagggaagcacaatgggataaggtaatcactttcagtgaaaaactgttttcttgaaaacaggcttggacacaattgaaagctggcttcctgcaaacacaccaagagtctgtaatctagcctatccattatatgtcctttattattcatgatatcctattcttctaccttgttgcctggtaactttttctgaggactgagtttctgcagcgatgtggtgcactcttcctgtgatgaggaaacatctgggcccccttctgcaggctttggaagatgatgtgtcttgtcaaggggtaaagggcaaatggatttaatttctgcttaaaactatcatagacgttccaaatagaatatgtaaaatt

SEQ ID NO: 28668 - DNA, 403 bp, Homo sapiens
gagagaggcgaagccggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatg

SEQ ID NO: 28669 - DNA, 469 bp, Homo sapiens
  misc_feature 26, 27, 28, 67, 77, 90, 131, 145: n = A,T,C or G
aacatggagactggcgagcacttgcnnntaccccaatccagacgaacgttcccaagtaagaactggnggagcagcangagcaaggagaanaaacacatctggtttggagaaaccatcaatggtggcttccnctttcagctatggngatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacata

SEQ ID NO: 28670 - DNA, 469 bp, Homo sapiens
  misc_feature 20, 48: n = A,T,C or G
gtttttggaatggagcctcncatcctatacaaccctttacaaggccanaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttc

SEQ ID NO: 28671 - DNA, 364 bp, Homo sapiens
ggttggaactgttctgacgtttctgccttaagcagcatcatggattatgggcctactcactcacattgggattgctggaagaggaataaatttgtaggaggtagaactggacttcactctcggacactgaatcgaagtgcctttgaaggccaggcatggtgactcacgcctgtaatcccagcactttgggaggccgaggtgggaggatcaccagaggtcaggagttcgagaccagcctggccaacatggtgaaaccctttctctactacaactacaaaaattagctgggcgtggtggtaggtgcttctaatctcagttactcgggaggctgaggcaggagaattgcttgaacgtgggaggcgga

SEQ ID NO: 28672 - DNA, 455 bp, Homo sapiens
  misc_feature 4: n = A,T,C or G
agtnaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagt

SEQ ID NO: 28673 - DNA, 124 bp, Homo sapiens
cagtaacttgtttacatagcatttgtgtaaagactatgatctcatcccaataaaatgatatattaaaccttcagattaatgactggctacagagtaacaaaaaataaagaatttaatgtacagt

SEQ ID NO: 28674 - DNA, 129 bp, Homo sapiens
  misc_feature 1: n = A,T,C or G
naagtaatgtgccataccgaatccgtgtgcggctgtccagaaaacgtaatgaggatgaagattcaccaaataagctatatactttggttacctatgtacctgttaccactttcaaaaatctacaccaca

SEQ ID NO: 28675 - DNA, 153 bp, Homo sapiens
  misc_feature 1, 54, 55, 56, 121: n = A,T,C or G
ngatggtagtcgcacgtgcctacgcatggtgaccacgggtgacggggtaatcannnttcgattccggagtagggagcctgagaaacggctaccacatccaaggaaggcagcaggcgcgcanattacccactcccgacccggggaggtagtgac

SEQ ID NO: 28676 - DNA, 150 bp, Homo sapiens
  misc_feature 11, 27, 33: n = A,T,C or G
cgatggtagtngccgtgcctaccatgntgaccncgggtgacggggaatcatggttcgattccggagagggagcctgagaaacggctaccacatccaaggaaggcagcaggcgcgcaaattacccactcccgacccggggaggtagtgaca

SEQ ID NO: 28677 - DNA, 100 bp, Homo sapiens
  misc_feature 32: n = A,T,C or G
atggtactggtataaaaataggcacatagatnatggaacagaatagagaacccagaataaacccaaatacttacagccaactgatcttcgacaaagcaaa

SEQ ID NO: 28678 - DNA, 267 bp, Homo sapiens
  misc_feature 4, 12, 15, 41, 73, 97, 216, 229, 262: n = A,T,C or G
gggnaatatagnagnaccaccacaaagtatactcctggggnaagagcaaccctaagcacacataatcgtcagnattcaccaaggttgaaatgaaagnaaaaaatgttaagggcagccagagagaaaggtaaggttacccacaaagggaagcccatcagactaacagcagctctctctgcagaaaccctacaagccagaagagagtgggggccaatnttcaacatttttnaagaaaagaattttcaaccccaaattttctttnccagc

SEQ ID NO: 28679 - DNA, 316 bp, Homo sapiens
  misc_feature 7: n = A,T,C or G
atagacnttctacataagcccagttatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcat

SEQ ID NO: 28680 - DNA, 155 bp, Homo sapiens
actcttttgtagatgaagcatctgaaacccagagcactaaaaggctttgcccaggatcacacagtttgtgataaaagtcagccctttgtgatttttgtgctctgccacttttggcttatggtggcacctttctaaagatacagaaggtttttttc

SEQ ID NO: 28681 - DNA, 471 bp, Homo sapiens
  misc_feature 31, 442: n = A,T,C or G
aacatagatttaagtgaatacattatacggngctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgangctgtaactgagagaaagattctggggct

SEQ ID NO: 28682 - DNA, 110 bp, Homo sapiens
  misc_feature 5, 7, 19, 35, 36: n = A,T,C or G
gggancnctgaggatgacnagcaaaattcaagaannaaaactgctccaacagacttttttaaaggaaaaaatatgtgtatcttgaaagctatttaaaatacactacttac

SEQ ID NO: 28683 - DNA, 419 bp, Homo sapiens
  misc_feature 12: n = A,T,C or G
gacaaccttagnccaaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacacta

SEQ ID NO: 28684 - DNA, 469 bp, Homo sapiens
  misc_feature 25, 109, 143, 173, 191, 207: n = A,T,C or G
attgggagaccaatgtaaaagacgntccttataacactgggcatttattcagcacttacgaagtgctggagctctacatgcatgatgcttaacccccaaggtaggctgnttttactgttaaatgtggaaaagatgagactcanaggagtcaggggccctgcatgagggcagcngaattggaacctccctgnctctctcctactgctncttttgttccctcttgctcctccagtagaccttcgtcctgctgacctgccctaacacccagatacccccccagggtcccctttcccccaaagcccactgaagacgggctccctttgccatcgagagctggcagagatccagagcgcttcccctaggattctgcaagttgtggttactgcagcctccatcctgttttgtattgggccaacccaatacaaaaccctatcttttgcttgaattcctcagggcagcagggaaaatt

SEQ ID NO: 28685 - DNA, 361 bp, Homo sapiens
  misc_feature 120, 132: n = A,T,C or G
aagatgaagtattcaagccgattcttctgcttcagtcgcccgagtggctgggattacgggcgcccacagctacgcctggctaatttttgtattgtagtggagacggggtttcgtcgtgtngaccacgctggnctcgaactcctgaactcgggtgatctgccctcttcggcctcccaaggttctgggattgcaggtgtgagccaccacgcctggacaagtttatccatctcttcttaacagccccctggcttttgtgttatagttacttctgcatttgccgaaaaattcttccttgatttccactgttcattttaggactattatggtttcttttgttgttgttgttgttgttttgttttta

SEQ ID NO: 28686 - DNA, 140 bp, Homo sapiens
  misc_feature 9: n = A,T,C or G
aattcggcnttatggccttcgcaagcaatgagtactcctctcctaaagaaagattacgttgatgaaaaagaacatcctgcccaggacccatcatacatattttcaagatcttatttaatttaataaacttactttacatt

SEQ ID NO: 28687 - DNA, 470 bp, Homo sapiens
  misc_feature 127, 130: n = A,T,C or G
attctaaagtaatgtcttttgttgtgggtttatgtgtaactacaggaattttggaacataaacattttgaaggatagtcaatggtatttagtcttggatataaaaatagagaaaatttatagctctntgntattcaaataatttatcacacagagtgatttgaggttttcgcagagtagatttgtttgactcatggtttattagtctggattacttaagaacaatatgttgattttaatgttaattcccactaaatatataatattgataaatacatgtgaaattaatattgtttggaaaatgtagaggacacagctgggaattatgaatgcttttttcttaataggtttggtgtgtgtggctttgaatggttctgctgatgcatcatggaaagacagcagggaactgcagcctgccatcaaaactgtatcaactcttttaatgagcatgtgactgtattaggtacattt

SEQ ID NO: 28688 - DNA, 200 bp, Homo sapiens
agtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgac

SEQ ID NO: 28689 - DNA, 462 bp, Homo sapiens
ggaagatgatgtcctgactgagcacagggataagaaggaattgggtggagaagagctagcatagaggttgtggtagagttagaagggagatgagaagaaaacactgtatatatacaatagaatactattcagcctttaaaaagaaggaaactttgtcattgccacaacatgaggggacctggaaggcattatattaagtgaaaaaaaagccaagcacagaatgacaaatgctatgtgatctcacttatatgtggaatctaaaaaaagtcaaactcatagaagcagaaaatagaacagcagttaccagagatggggttgggaggaggggacaggattggcaagatgttggtcaaaggacacacaagtttggttagagaggagacataagctcaagagatctattgtccctcatgatgactataattaataacaatatattatatacctgaaaattgccagcct

SEQ ID NO: 28690 - DNA, 230 bp, Homo sapiens
  misc_feature 207: n = A,T,C or G
acagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgncttcatttaaaagaataatgctc

SEQ ID NO: 28691 - DNA, 456 bp, Homo sapiens
gaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagactatgaaaatattgtcaagagtttcagatagaaaatgaaaaacaagctaagacaagtattgggaga

SEQ ID NO: 28692 - DNA, 438 bp, Homo sapiens
ggtttctgattggttgcatcatgtatgacgtttgcaaagtgcatgtggaaggctggtcgccccaccctaatcttatgcaaatgggctttccagttgattgggtccatcttgtgtaacacgtggctggcagagaagggaagatgaagccaccatcttgaaaatgtctagtccttagtttctgctggcattcacccatgcaagctgccagcttgtctatgtctgcagctcaactttacaggctgctctttgttagcaaatgatttggagcttcttttcattaaagaaaaaagccttaccgaggactcccatacccttgctttctgcttaagtgatttcttcttaactcctatgtcaattttatacagcatgaaataatgatgtatctataaatgagcctttgcaagattaccatttatcaaagaaaaccagtgatgttta

SEQ ID NO: 28693 - DNA, 301 bp, Homo sapiens
atgaaagaggaagtgaggccaggcgcggcggctcacgcgtgtagtcctagcactgtgggaggccgaggcgggcggattgccaaagctcaggagttcaagaccagcctgggcagcatggtgaaaccctgtttctactagaaaatacaaaaaaattagctgggcgtggtggcatggcctgtggtcccggctgctcgggaggctggggcaggagaatcgcttgaacccaggaggcgtaggtttcagtgagctgagattgtgccactgcatttcagcctgggcgacagagtgcaactctgtctca

SEQ ID NO: 28694 - DNA, 461 bp, Homo sapiens
gttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccat

SEQ ID NO: 28695 - DNA, 334 bp, Homo sapiens
  misc_feature 106, 158, 168, 185, 203, 212, 269, 273, 325: n = A,T,C or G
acatcaatgttagactagttgaagtggaattgtataattcaattcgataattgatctcatgggctttccctggaggaaaggttttttttgttgttttttttttaanaacttgaaacttgtaaactgagatgtctgtagcttttttgcccatctgtagngtatgtgaanatttcaaaacctgagancactttttctttgtttanaattatganaaaggcactagatgactttaggatttgcatttttccctttattgcctcatttcttgngacnccttgttggggagggaaatctgtttattttttcctacaaataaaaagctaanattctattt

SEQ ID NO: 28696 - DNA, 351 bp, Homo sapiens
gaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaagcactgcagtttaccatgggacactgtatatatttcttgccataatggtaaaggactgattgatatatttaagagttaataaatttgtgatctctgctg

SEQ ID NO: 28697 - DNA, 132 bp, Homo sapiens
  misc_feature 51, 64, 66: n = A,T,C or G
cgatggtagtcgccgtgcctaccatggtgaccacgggtgacggggaatcanggtttgattccgnanagggagcctgagaaacggctaccacatccaaggaaggcagcaggcgcgcaaattacccactcccga

SEQ ID NO: 28698 - DNA, 462 bp, Homo sapiens
  misc_feature 17: n = A,T,C or G
gagagactggctcaagnaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttct

SEQ ID NO: 28699 - DNA, 162 bp, Homo sapiens
acgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccc

SEQ ID NO: 28700 - DNA, 254 bp, Homo sapiens
aggaatgaaaaagaaggaatactactttctaagaaagaagatcttataatagacatatttagtaggttaaactactcctttgaaagaataagttttggttcaaagtcaataatgaagacgagatttgtttttctcttctctggctgatttttaaggatattatgtagttcatttagttaacagaattgaaatgtttgatatggcaagataggtatggtaatttcaaagtgaattgggaattcctctggctcata

SEQ ID NO: 28701 - DNA, 246 bp, Homo sapiens
gttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgactt

SEQ ID NO: 28702 - DNA, 480 bp, Homo sapiens
agagcaagcaaattcaaaagctagcagaagacaagaaataacaaagatcagagcagaactgaaggagacagagatacggaaaacccttcaaaaaatcaatgaatccaggagctgtttttctgaaaagatcaacagaatagatagaccactagcaagacaaataaagaagagagaagaatcaaatagacgcaataaaaaatgacaaagaggatatcaccactgatcccacagaaatacaaactactatcagaggatattataaacaccgctatgcaaataagctagaaaatctagaagaaatgaataacttcctgaacaatacactcttccaaatctacaccaggaagaagtcaaatccccagatagaacaataacaagttctgaaattgaggcagcaattaatagcctaccaaccaaaaaaagtccaggaccagatggattcacagccaaattctaccagaggtacaaagaggagctggt

SEQ ID NO: 28703 - DNA, 299 bp, Homo sapiens
  misc_feature 27, 28: n = A,T,C or G
ggagtccacacggcacacacaagcggnnctgagaagcacgatggctctagtcagaggactttgctgtcggtccagatttgaagaggacacggaacagcatgagcctttgtgacaaaactagaatttggaaatgaggactgtcttgggaaaagggtagacacaggcacttctctccacagcctgctaacctaatgtgggcagaactgaaagatcactgcagtggaaactgttctggaagaggctgcaacatagcccatgcttagggactggatggtttttgcaagagctttttttttttt

SEQ ID NO: 28704 - DNA, 153 bp, Homo sapiens
  misc_feature 19: n = A,T,C or G
gaaaaaggtaacctcaaanctaaaaagcccaagaaggggaagccccattgcagccgcaaccctgtccttgtcagaggaattggcaggtattcccgatctgccatgtattccagaaaggccatgtacaagaggaagtactcagccgctaaatct

SEQ ID NO: 28705 - DNA, 378 bp, Homo sapiens
aataaataaaggtccaagtgtgttctataacatgagaaactgcaactatgtgtcaataaaaattatcagtacaagaaaatattatttctcaaggtttgatgtcagatcaaacatcattttctcagggacccctcttatttaaggctcccagctatatgtccccacaatgtcctctattcttcctaacagtgtctgtactttctctgcttgtataatgtctggttttcccagcagactgtatgctccatgaggataagggccatgtctacagccccagtggctaagtaaaaagggctcaataaatttttgttgaatataaatttaaaaagctatttccatataatttttctaaaaaattatttcatcatttgttactga

SEQ ID NO: 28706 - DNA, 244 bp, Homo sapiens
  misc_feature 175, 180, 227, 243: n = A,T,C or G
aagttcaaaatcgggcaaataatctctggccatagaagtcagagaagtgtgggatggggatacacagagatggacacgggagaaactttggggtgctggaatgtcctttatttacattttactttagcgacagagcgagattctgcctcaaaaaaaaaagtaggccttgccaggngcagngggaggatcgcttaaggccaggagtttgaaaccagcctgggcaacgngacaaaaccccgtctnt

SEQ ID NO: 28707 - DNA, 447 bp, Homo sapiens
  misc_feature 10, 48, 62, 164, 295: n = A,T,C or G
ggtgattatnaggcagaataccctgatgagtatcatggcgagtaccangatgactaccccanagattaccaatatagcgaccaaggcattgattattagatccacacagaaggagctcagtatttagtcctttgtttttattcagtgagaaccaagctagcctngagtaatttttatcttgtcttcctaaaacactattaagcttattgtacttttaagaaaaattgccttacgtacattcctttttcctttttctgcctcttccctcaatagttgccttttagtgctgtaatanttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaact

SEQ ID NO: 28708 - DNA, 322 bp, Homo sapiens
gacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgcctctcagatgtaaatagagcaacctatataaacctggatttttttttttt

SEQ ID NO: 28709 - DNA, 398 bp, Homo sapiens
gaatattttaatattattcttaattcaggagcccatctgggtcagaacttttcctcctgtttgtttttatttactctacccaggagttcataataatgaactaaaacagctacggggccgggccgcagtggctaatgcctgtaattccagcactttgggaggccaaggcaggcggatcacgaggtcaggagatcaacaccatcctggctaacaatggtgaaaccccatctctactaaaaatgcaaaaattagccagacatggtggcgcatgtctgtaatcccagctgctcgggaggctgaggcaggagaatcacttaaacctgggaggcggaggttgcagtgagcttgagatcacaccactgcactccagcctgggcgacagagcgagactccatccc

SEQ ID NO: 28710 - DNA, 249 bp, Homo sapiens
  misc_feature 7, 8: n = A,T,C or G
caaggannagtgctgtgggtccagtcatctgtttcatggaattcaccagtctggtatcttcaaaatccagaaggatgatggcagatggcaggaaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggcc

SEQ ID NO: 28711 - DNA, 233 bp, Homo sapiens
acagttttacatatttagttcaagggtaaaatccaatctacccttgggccaaattatcctgcactatgggctggtaggatataaattaatcttactgctatcaatatgaccagttgttatccaaatttattaatataaaatcaacaaggtagataaatttgagaaactagtggacccttgtacagtaaataatattaaagttagttggtaaaaaataagtgaaatgtgtgaac

SEQ ID NO: 28712 - DNA, 425 bp, Homo sapiens
  misc_feature 191, 415: n = A,T,C or G
aaaataatgggggatgtttctttgttgctgtagagagatgatttatatgcataggcacgttggttgtttctttctcccgagatgaagtcatctttttttcaatacttatccacatcacaaagctcccaagccttgattagcacagttgtctcagcacattggtgttccacaggaatgcaaaggcgcgtctnccctttagtaagtctgtatccactgacacccatgctcctggtaaaatcggaacctctattaaagtagctgtaagttaattattattgagcaatgttttggcatagcccctatagactgcctgctgaaaacctggaccaggactggatccgtaaggtctgccttcagccgcttttccttgtatcagttataattagatctctttaccactgataggcttaatggntaatcaacac

SEQ ID NO: 28713 - DNA, 370 bp, Homo sapiens
  misc_feature 11, 318, 345, 348, 368: n = A,T,C or G
ctgcatagagnagctataagcagcaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctnactccgagaacaggagaaatgaacatngcnggaacaaaagaatgggtatnat

SEQ ID NO: 28714 - DNA, 472 bp, Homo sapiens
gcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtactt

SEQ ID NO: 28715 - DNA, 134 bp, Homo sapiens
  misc_feature 47, 79, 120: n = A,T,C or G
cgatggtagtcgccgtgccgtaccatggtgaccacgggttgacgggnaatcaaggttcgattccggagagggagcctgngaaacggctaccacatccaaggaaggcagctggcgcgctanttacccactcccga

SEQ ID NO: 28716 - DNA, 430 bp, Homo sapiens
ggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttca

SEQ ID NO: 28717 - DNA, 372 bp, Homo sapiens
aagtacagagtagtatatagtgaatcaaaactaactacagccattctttttaaagcccaagggatggagcaaaggtgtaaggatgttacctgtttgttttaatcagagagcaaaaagaagtcacaatagtttgggagaaaaagtagtatggtgagtaaggttatgcgtataatttcatactgaatttattactatttgggatgtacgccaatgttctaacaaacactgccaacacgtcaattttttaaaaagcgtgggccacattgctaagaatttgttaaagcataactgtattttttgttttagggccttattgatgttttgccgttccaatgtatgcatttttttactcaataaacttgtcttaatttt

SEQ ID NO: 28718 - DNA, 420 bp, Homo sapiens
  misc_feature 57, 78, 147, 150: n = A,T,C or G
atttatggacacagcataaagtagcctaggatagcagaacacttttagtttaagttngttctagatccttaaccgctntggaccataagtctagcattaagtggcaggataatgaatataatgacaaaagtgaagtgcttaattgtngtnatgcatgatattggtagagtgtcagtatccatttgtgtgtgtatataaaacaaatgaggctctggtttcgagtttcagctttataaatggctgactgtgcagttacaccatgtctacctaagtatctttgatactgtgtcatgatcacatttctaaactctatagtctttctgcctcacggagatttgagataggtcttaatttttaaaattaaacttactcatattaaacaaagacatatgaagactttagtaagatatattatgatat

SEQ ID NO: 28719 - DNA, 163 bp, Homo sapiens
gtacgactcttagcggtggatcactcggctcgtgcgtcgatgaagaacgcagctagctgcgagaattaatgtgaattgcaggacacattgatcatcgacacttcggacgcacttgcggccccgggttcctcccggggctacgcctgtctgagcgtcgcttgct

SEQ ID NO: 28720 - DNA, 471 bp, Homo sapiens
ggatgtcctgcatctaacgcggtgtaacccccgagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaata

SEQ ID NO: 28721 - DNA, 345 bp, Homo sapiens
gggtaagctaacaggtacaactcatgtttgcagccttcgaagatgtaacaatctcgttggaaacataagacatacatcacattatacacaaaagtgtatgatatgtacaactgagtggtacagatatgacatggaagatctgggggaggaagttcaaggaaggcaccacaccagaaatgggacctaaattaaggcttaaagaatgagcatggccacactgtcagtgagtgttctttaggtggtaggactatggttgatatttttcttcttcctatcttcctgcctttttcagattttcaatattaaacttgttattcttacattggaaaaaaataaattgtttgt

SEQ ID NO: 28722 - DNA, 446 bp, Homo sapiens
  misc_feature 32, 446: n = A,T,C or G
attcggggtaaaacacatctggtagaaaaatnaacttagtttcattgtttagggttccaattagatgattaaatactttctctggatttgcaagagtcaaagaaacaggttacacagagggtaagaaaaactccttcctgttaataacacaatgttagaaggtcccttacaatgtaactaaaaaatgctcaggcaagaaccatcctaaataatatatcagtcatttcttgaagtagcaagtgttgccttaaaataatgttttatgaatacccatagattaaagaaacacaaacaattcccacaaccaatctgtgaacacatttatgaggtatgtagagctagttatgaacattcaacaccattgacgtgctccttttttttgaattataagtaatgattaactttactaaaatgcctatgatatcctctagtgtgtgatcacttan

SEQ ID NO: 28723 - DNA, 469 bp, Homo sapiens
  misc_feature 5, 68, 93, 444, 452: n = A,T,C or G
ggccntcttgtcttgttcccgaataagtagaagcatcgaaagcgttggagaggtgttaccggaacggnggcgacaagggtgttcccgaactanagtggatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaaccccccacaccccccctncagatcanccatggatgccaccaac

SEQ ID NO: 28724 - DNA, 399 bp, Homo sapiens
gaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaat

SEQ ID NO: 28725 - DNA, 461 bp, Homo sapiens
atcgtgagtacctggcttgcagtttcttcaaaaaacattgacatcacagaacacatagattttgccacccctatacagcagccagcaatggagcctctttgcaatggcaatctccccacgagtatgcataccctggaccacttgcatggggtttccaaccgagccagcctgcactacacaggggagagtcagttaacagaggtattacaaaatctcggcaaagaccaatatccacaacagtcgcttgaacagattggcacccgaattgccaaagttttggaaaagaaccagacgtcctgggtcctctccagcatggcagccctctactggagggtgaaaggccaaggaaagaaggcaatcgactgcctccgccaggctctgcactatgcgccacaccagatgaaggatgtgcccctgattagcctggccaacatcttgcacaatgccaagctctggaatga

SEQ ID NO: 28726 - DNA, 201 bp, Homo sapiens
gttaaatactaaggatccagagttttaacaacattattccatcccctctagatctttaagtatactagatgaaactgagacaagaaaacccaaccataataactatcacatgaatagtggaatacactaaggaagggacccaactgttaactttgcatggctggaagtgggatgggagggggagtgtaaaggaagcttctc

SEQ ID NO: 28727 - DNA, 172 bp, Homo sapiens
  misc_feature 23, 33, 34, 43, 46, 51, 61, 67, 78, 87, 92, 94, 102, 117: n = A,T,C or G
ccccggggaaatgggtctctttngggccggggnnagaaaatcnagnaagcnaatggaacantgcctntgcaaattgcngagaaaaanatganantgctaggnaatctataactagtncaaactatcaattaaatgtgaggatagaattaagactttttggatatggaagatt

SEQ ID NO: 28728 - DNA, 158 bp, Homo sapiens
tctaaatccccttgtaaatttaactgttagtccaaagaaggaacagctctttggacactaggaaaaaaccttgtagagagagtaaaaaatttaacacccatagtaggcctaaaagcagccaccaattaagaaagcgttcaagctcaacacccactacc

SEQ ID NO: 28729 - DNA, 153 bp, Homo sapiens
ataaacatctgtataaaaatttcaaacatattagcaaatggaacacaaaatagattgaatggataatacatcataagcaagtggggtttattccaaaaatatagggttggtttagcagaaaataaatcaatgtattcagaatattacaagcta

SEQ ID NO: 28730 - DNA, 348 bp, Homo sapiens
  misc_feature 344, 345: n = A,T,C or G
agttttcaaagggaatgcagcagcctgtttcttttacatttttcttcacctttcattttcagttcatttctgtttctttttctttcccactaccttggaatatgcacagagctgccttgtcttggggagtcctcagcttgagcctgctttccctattagtcaccacactacagtcacccagcctgggcgacagagtgagagtctgtctctaaataaataaataaacaaataaatctacagttaacatcatacttactgatgaatgacaacattttccctaaggtcaaggacaagacaaggttattctaaaagtattccacattgccctggagtgcttgcaattnngac

SEQ ID NO: 28731 - DNA, 464 bp, Homo sapiens
gctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttgg

SEQ ID NO: 28732 - DNA, 429 bp, Homo sapiens
tactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatg

SEQ ID NO: 28733 - DNA, 438 bp, Homo sapiens
  misc_feature 27, 29, 41, 47, 92, 110, 120, 132: n = A,T,C or G
caaataaaatttagcaaagaacaacanancagggaaagggntctgtnacaaacatggcaactagctcatataaaactatgagaaaaacgcangcaacctgccaatagttntaaggcgacnagagatcataantagataacgactataaaaggtctgaacggagttcaccaagaggaaatgccagtggctaataagccagtggaaaatgtttaaaatcactagcaaaacaatttcacctctcgcaacagtgccaggaaagattgatataataatatgttcaacgtaacattataattaggaaattctatttataagttaaagtaatagctaggaaatgatgaaatgaaacgtgatattatatcatggaataatatacagccattaagatgatttttacgaatatttttaaggacacagaaaaatccctttgctgaaatg

SEQ ID NO: 28734 - DNA, 430 bp, Homo sapiens
attggaagctagaatcgaatggaacaatgcctttgaaattctgagaaaaaaatataatctggaatctataactagtcaaactatcaattaaatgtgaggatagaattaagactttttggatatggaagattaaaaaaaatttactacctacattcctattctcaggaggctgtgagtggaagtactgtactaaaaggaacgaaaaaactgactaaactggcagctacaaggttgaagaaacaggaggcccaatacaagaaagaagtgaacagaatcctcagggatgatggtgataacgacttgttctagaactaaaatccccaaagataaaactattggtacacttgatgcttcagtgtattaagaggagatttagacaaacaggggagagtttcaggatcaagttctatgtactaaatacatagaaaac

SEQ ID NO: 28735 - DNA, 470 bp, Homo sapiens
gtaggcatgacatttgcacagttagctattattttcattacagtagctgcatacaaactttcctgactatagacttatttttgtgagagcaaaaataaattatagaattctgagattttttttaatctatgccttttccaaaagatacgttttagcttaaacaattatttgaattgtgattcacatgattataaagactttccaaagatcttatttagattataaggattatttaatttctaataaatttatatttttataaaggaggaaaaactgcccggtattccttgttcaacaaagataaattattctttccttaaaaatttgttttgaaatacttgttttgatttccagctatttgtatcatccaggtttaacaaaggggaaaactctttattattttctgattgacttatagaaaataatcagttttaaatgaagttagaaaatgatcacataagaaattttac

SEQ ID NO: 28736 - DNA, 367 bp, Homo sapiens
  misc_feature 10: n = A,T,C or G
attgacaagnaaatgccccttcactggtaatgtgtccattcgagggcggatcctctctggcgtggtgaccaagatgaagatgcagaggaccattgtcatccgccgagactatctgcactacatccgcaagtacaaccacttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccct

SEQ ID NO: 28737 - DNA, 444 bp, Homo sapiens
  misc_feature 12: n = A,T,C or G
atctgttaaagnatactatgatttatggattaaatgataaaatgcctggaatttgcttcagaataattcatattgagtggatgggggttcaaatgaaacaagactggctctgattttggtaaatttgaagctgactgatggaatacttgtactattctgttttttaatatagctgaaatttttataagttataaaagaaatatgcaatctaggtgtagtggcttgtgcctgaatcctggttacatagaaggatcccctgagcctagtaattcaaggctgcagtgagctgcgatcacatcactgcattcccgcctgggcaacagaagtagactccatctctaaaaagaaggaaagaaaaaaaggaagaaatatacagtaattttaaactgggagatgaaatgctaatttctagaagtccatttggttttgaagggtctcatgtcc

SEQ ID NO: 28738 - DNA, 468 bp, Homo sapiens
  misc_feature 17: n = A,T,C or G
aatgttgggtagaaagnacaacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgaccagacagcctccccctgtcccctctatgacctcgccctccacaaatgggaaaaccagactacttgggagcaccgcctgtgaaataccaacctgaagacacggttcattcaggcaacgcacaaaacagaaaatgaaggt

SEQ ID NO: 28739 - DNA, 405 bp, Homo sapiens
cactacccacatgtaactttttaagtatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagct

SEQ ID NO: 28740 - DNA, 230 bp, Homo sapiens
catcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgc

SEQ ID NO: 28741 - DNA, 473 bp, Homo sapiens
gtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacgctagaaaggggaaataaagtacacaagtccaagtctaaaactt

SEQ ID NO: 28742 - DNA, 328 bp, Homo sapiens
ctggattctgaagctgtcttatccagtgcccagcacacagttcttggtgtctggctggtatttaaaaacagctactttgggaggccgaggtgggcggatcacttgaggctaggagttcgagaccggcctggccaacatggcgaaaccccgtctcaactaaaaatacaaaaattagccggatgcagtggcgtgcacctgtaatcccagctactcaggaggctgaggcgggagaatcgcttgggcctgggaggcagaggttgcagtgagccaagattgaaccactgcactccagccttggcgacagagcgagaccctgacccgtgtctcc

SEQ ID NO: 28743 - DNA, 339 bp, Homo sapiens
ccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 28744 - DNA, 249 bp, Homo sapiens
agcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctga

SEQ ID NO: 28745 - DNA, 170 bp, Homo sapiens
gtctctactaaaaatagaaaaagttagccgggcgtggtggcgggcgcctgtagtcccagctactcagcaggctgaggcaggagaatgacgtgaacccgggaggcagaacttgcagtgagccgagatcacaccactgcactccaacctgggtgacagagcgagactccacc

SEQ ID NO: 28746 - DNA, 489 bp, Homo sapiens
atatgaagtaccctagcctcattctactatcaacattactaataagtggctcctttaacctctccacccttatcacaacacaagaacacctctgattactcctgccatcatgacccttggccataatatgatttatctccacactagcagagaccaaccgaacccccttcgaccttgccgaaggggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctgacctccctgttcttatgaattcgaacagcatacccccgattccgctacgaccaactcatacacctcctatgaaaaaacttcctaccactcaccctagcattacttatatgatatg

SEQ ID NO: 28747 - DNA, 198 bp, Homo sapiens
ggagaaaagaagatgatcaatacatgcccatcctgagatgattcaactattggaatgatcagatacagacttcaaagcagctatttataaccagccttcagaaagtattggtgaatattcttaaacagaatggagatgacaaagcatggagtccataaattagatgatagtttggaaaaagatataaacttacaaact

SEQ ID NO: 28748 - DNA, 464 bp, Homo sapiens
  misc_feature 11: n = A,T,C or G
cagctgcgggnagaaatatggggacaagatgttgcgcatgcagaaaggtgacccacaagtctatgaagaacttttcagttactcctgccccaagttcctgtcgcctgtagtgcccaactatgatgatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgcccaggcgttatggggatttc

SEQ ID NO: 28749 - DNA, 467 bp, Homo sapiens
  misc_feature 18: n = A,T,C or G
caacttggctcccaaaancacaggtgggtcctgttgtagctacagggagctgtttcgagaaggctggaaacccaggtggccgagtccaggtttcactggagtgggtggatgggaagcccaagcctgtcctatgtcatgtctctagagagtgcactgaactctctttaggggggtaactaagaaatattgaacacaccctcatcaggagccgtggcaggagtgatggggtctgggcacaaatgctggttgtttagattcctgtcgagtaagtgcttggtgccaagcaaaagaggttgcgctgagaactggctcagatgttgcacagagactgtcagatggactgtggctcagggcctgcggggaatgcccccagtttctttactcttggggctttcatgggctccacgtgtggctctcagagtcccctctctgctgcctcttgaccaaggatcagtttctcctaaaac

SEQ ID NO: 28750 - DNA, 333 bp, Homo sapiens
  misc_feature 16: n = A,T,C or G
ctcagtattctttttngcctcatgtcttttgaagcaggggagagtcaagaaatacaaaatcatatctcataaaccatgatttaaaaactcatttgcaattatttcttgggtagtctggcaccttacttggaaatatggaactgattggcacctagtgttttgggactcttgctctcttgctgaaaataaaacataaatagttatatactgtgtatctatctattatctatctagaaagagagagaaggagagctgagagataacatatatagaaaattaggaatatatacaatacacatgatatatgtatatatctgtatatatataggagac

SEQ ID NO: 28751 - DNA, 308 bp, Homo sapiens
  misc_feature 9, 305: n = A,T,C or G
gaatccagnaggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaanctc

SEQ ID NO: 28752 - DNA, 267 bp, Homo sapiens
  misc_feature 266, 267: n = A,T,C or G
ggtcattgccatttaaataaattccttaatcttgtatttttattggttgttcattagagatttaagaatgtatgacatttaagaaatatgaacattttggaagtaataatattttaataatgccacactgaactattaataaattttaatgccacaattactgttcagaatgtcttttattagctaaatgtatcctctcatgatttgaaatataataaaagtacaaatttaaaccttactatagcaccaaataaattgcttatgcnn

SEQ ID NO: 28753 - DNA, 241 bp, Homo sapiens
  misc_feature 14, 20, 37, 38, 39, 53, 54, 56, 58, 59, 68, 69, 71, 75, 77,80, 85, 87, 89, 90, 95, 96, 102, 103, 110: n = A,T,C or G
atgcagcgctatgnatattntgacctggtaaaagagnnnagattgtcggatgnngngnncaatgaacnntncatncncgnaaganancnnctccnnccccgnncaggctnagacgtttatttagtaaaactacaccatgcgactactaaaccgtacaaaatgttgtagtaccattaacatagaacaaagtgaatttaagatggaaggtatcaattggaataaaaaaaaaagggacactacc

SEQ ID NO: 28754 - DNA, 455 bp, Homo sapiens
caggcgtggtggcgtgtgtttgtaatcccagctacttgagaggcgcgtgtttgtaatcccagctactggagaggctgaggcaggagaatcgtttgaacctgggaggtggaggttgcagtgagccaggattgtgccatgcactccagcctgggcgacagagcgagactctgtctaaaaaaacaaaaataaaaacaaaagtatcgcacatgtaattatgtacagttcataaaatttgatgatggtaaatgactatgctattgcttatgtatttactataccatatttttatcattattttagagtgtactccttctaaatatatttaaaaaagttaactgtaaaacagcctcaggcaggttttccaaaagaaggcataggatatgacagttccatgtgtattactgtccctgaagttcttccagtgggacaagatgtgaagatgtgggtgtggagaa

SEQ ID NO: 28755 - DNA, 160 bp, Homo sapiens
  misc_feature 2, 5, 29, 43, 53, 129, 157: n = A,T,C or G
gnagngctgcccgtagcccgtaccatggnagtacacacggganggacaggggnaatcagggttctgattccggagagggagcctgagaaacggctaccacatccaaggaaggcagcaggcgcggcaaantacccactcccgacccggggcaggtagngac

SEQ ID NO: 28756 - DNA, 157 bp, Homo sapiens; identical to SEQ ID NO: 27889

SEQ ID NO: 28757 - DNA, 218 bp, Homo sapiens
  misc_feature 212: n = A,T,C or G
tgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcngcggtg

SEQ ID NO: 28758 - DNA, 302 bp, Homo sapiens
ctggatgagccggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaat

SEQ ID NO: 28759 - DNA, 456 bp, Homo sapiens
  misc_feature 100, 190: n = A,T,C or G
gcttagcgttaagtttttaacgtaattttaatagcttaagattttaagagaaaatatgaagacttagaagagtagcatgaggaaggaaaagataaaaggnttctaaaacatgacggaggttgagatgaagcttcttcatggagtaaaaaatgtatttaaaagaaaattgagagaaaggactacagagccnccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggaga

SEQ ID NO: 28760 - DNA, 359 bp, Homo sapiens
  misc_feature 16: n = A,T,C or G
aggccggggggaaggnatgggaatgggtgtgaccttagacttggttaatttgaaatggtactaacatctccaggtgggagagttagcagaagattggaattgggccaattaggggaaaggggtaggctgaagctagagagagacagagagatgcccttttgaaggtcatcttcacagaggtaacaattgaagctattgaagcagctgagatcacagcagaaagccaggaacacaatcctagggaagacccacatttattgggtagaagtcagatgtggaaccactagaagaagcagacatacatttagaaatagtaacaaaagcatggtggtgtgatattaaggaagcctaggaaattc

SEQ ID NO: 28761 - DNA, 274 bp, Homo sapiens
  misc_feature 12: n = A,T,C or G
tatggcccgggnaactaaacaaatatttgcatccaaggttatttcctttgagggacccaggcacattttgtgttgacttctggccccattgacaggtcccagaaaggactggtgagggccattctttctgagatggttccccttactgctttcctctgtcctgatgtgggaatagggggaagggggtgctatgatccttttatgcctgatatgtgcctggtaaagaattctagaactggccaggcacagtggctcatgcctataaccccagcac

SEQ ID NO: 28762 - DNA, 191 bp, Homo sapiens
gaggaaaaattacctgtcttgactgccatgtgttcatcatcttaagtattgtaagctgctatgtatggatttaaaccgtaatcatatctttttcctatctgaggcactggtggaataaaaaacctgtatattttactttgttgcagatagtcttgccgcatcttggcaagttgcagagatggtggagctag

SEQ ID NO: 28763 - DNA, 237 bp, Homo sapiens
  misc_feature 233: n = A,T,C or G
gggcttactgggaaaggctcctgccaagttgctcccacaatggagggccttatgatggcaatgttcaggttcctgctctcttgctgcaccaccatttctcccaaggccttggtgtaggtataaatattgggccaatctctgatcagcttgggtgtaatctcgtcaataatagcatcgtctaaccacctaaaaggtagagtaaagagaattctagtaacatatgttagacaatnaacc

SEQ ID NO: 28764 - DNA, 417 bp, Homo sapiens
  misc_feature 1, 11: n = A,T,C or G
natccacatgnaaatttttcctgtgtgtctgtctgtgtccagattgtcttctttttatgggggccattcattggattagggtcttccctaatgcagtatggcctcatcttaatgtgattacatctacaaaaatactgtttcaggccgggcctggtggctgaagcctgtaatcccagcgctttgggaggctgagacgggcggatcacgagatcaagagatcgagaccatcctggtcaacatggtgaaaccccgtctctagtaaacatacaaaaatcagctgggcgtggtggcacatgcctgtagtctcagctacttgggaggctgaggcatgagaatcgcttgaacccgggggcagaggttgcagtgagccgagatcgcaccattgctctctagcctggcgacagagcaagactgcgt

SEQ ID NO: 28765 - DNA, 152 bp, Homo sapiens
  misc_feature 11, 140, 146, 152: n = A,T,C or G
gaggccggggnagtggcggtgcatcgacttgtacttctagctgaactgcctgttttttaggtttttttttcccaaccatcttaactgattaaagtatcctatcagtccccaaatatcaagaagcccatttccaaatgtgnggcatnggtcan

SEQ ID NO: 28766 - DNA, 116 bp, Homo sapiens
gtaatcatgtagttgaagtctgtggatgcagctgttatgaagatggttaaacttgaaacaaacaattttaagaattatttggtctgaagatgttttaccttaaataaatgtctatt

SEQ ID NO: 28767 - DNA, 214 bp, Homo sapiens
attgtggtgtattataattagttttgtgaatagaaaaataaagcacttatgtttaaatttgttacagtgacttttaaaggattaatgttgaatcacattgtcagaattttttcctcctcgctgttcaattttgtagtttttactctcaaaaaatgaaattctcaaaattatatagctttttgttttgtttgaataaatgattcattcctgtttg

SEQ ID NO: 28768 - DNA, 398 bp, Homo sapiens
  misc_feature 23: n = A,T,C or G
gacggttcgtttttcctttagtnggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaaga

SEQ ID NO: 28769 - DNA, 448 bp, Homo sapiens
  misc_feature 40: n = A,T,C or G
atggcccggggctttttgtccgacatcttgacgaggctgnggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatga

SEQ ID NO: 28770 - DNA, 190 bp, Homo sapiens
  misc_feature 1, 50, 53, 71, 126, 137, 154: n = A,T,C or G
nctttctaagtgaggcacacacttctggcgcaaaacattttctatagacntcnacagaacactccacccancaaccgatgtaatatacatttgtctcatctgcacacatgactgtcttctaagatngaccacatgcntggtcacaaagcaagcntcaataaattcaaaaacctggaaatcataccaagga

SEQ ID NO: 28771 - DNA, 458 bp, Homo sapiens
gggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtcttta

SEQ ID NO: 28772 - DNA, 330 bp, Homo sapiens
aaacactttctcggcctatccggaatgccccgacgttactcggactaccccgatgcatacaccacatgaaatatcctatcatctgtaggttcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctaaacaaaaaaggaaggaatcgaaccccccaaagctggtttcaagccaaccccatggcctccatgacttttcc

SEQ ID NO: 28773 - DNA, 282 bp, Homo sapiens
attgagactatatttatatttgacttggcaacattaacatgtcctaagacttagtgcagagaagcttggcagtacgttctttgacttaaggatggcataaaataatcatttttgaacctgtgtaataaagcttgaaagcagggaaaagaatttccttttcccccttttttgtgttgtctataggaattaacttgggattgttttgtgggtttttgtttgttttaaatgtaaattgagaatcttttataagaaataaaagcattattgggtgcctttgtttgt

SEQ ID NO: 28774 - DNA, 409 bp, Homo sapiens
aggagttcaagcctgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaat

SEQ ID NO: 28775 - DNA, 165 bp, Homo sapiens
gatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaactt

SEQ ID NO: 28776 - DNA, 340 bp, Homo sapiens
  misc_feature 19: n = A,T,C or G
ggctggggaggccccaggnaaacttacaatcatggcagaaggggaagaaaatacatccttcttcacatggcagcacaaggagaagtgcagagcaaaaggatgaaaagttccttataaaaccatcagatctcatgggaactcactactatgagaacaggggtaacctgccccccatgattcaattacctcctgctgaatccctcccacaacttgtatgtttatgggaactacaattcaagatgatatttgagtgggaacattagatttgagtggggacacatccaaaccatatcaaatgttctggggttattaaccaatgcaattagtcaagaaaaggaat

SEQ ID NO: 28777 - DNA, 240 bp, Homo sapiens
  misc_feature 19: n = A,T,C or G
ggcgacaaacctaccgagncctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacc

SEQ ID NO: 28778 - DNA, 140 bp, Homo sapiens
  misc_feature 24, 32: n = A,T,C or G
agtgataatctgatgctgaagatnaaataacnaatataaagcatatttcttggccttgctccacaggacataggcaagccttgatcatagttcatacatataaatggtggtgaaataaagaaataaaacacaatactttt

SEQ ID NO: 28779 - DNA, 430 bp, Homo sapiens
  misc_feature 426: n = A,T,C or G
atccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttatttaattnaaga

SEQ ID NO: 28780 - DNA, 294 bp, Homo sapiens
catagatggaggctggactagttggaacctctaagatgtcccctctttcccatgatgtctcttccatcagggcctcttcatatggcctctttctttaacaagttagcctggactttttaatagcattacagctggatgtcaagattgcaaaagtagaagcttccaggcctcttaaggccttgtcccagaagtggcacagatcagggaagcccgttgctttagccaagtgcatgtacctatgaaaatcttaagttttagagataaagtaggtattaccatcatagaaggggtttc

SEQ ID NO: 28781 - DNA, 385 bp, Homo sapiens
cacattttatctactcatcacttggtggacttttgggtcattcactttttggaaataattatgaattatgaataatgctgctatgaacatttgtgtaccagttttggggtgaacacatgttttatttcttttgcatctatacctaggtatctaattgctggatcatatggcaactctgttgtttaactttttgaggaactgccaaactgttttccaaagctgctgcaccattttatatttccaccaacagtgaatgggggctctactttcttcacattctcaccgtgtgttattatctcttttttattattattatagccattctagtaagtggaaagtgggattgcattgtgttttttatttgaattttcctgatggctagtga

SEQ ID NO: 28782 - DNA, 272 bp, Homo sapiens
agcttaagaattgctaggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgcctttctga

SEQ ID NO: 28783 - DNA, 248 bp, Homo sapiens
agcctgtaatcccgcactttgggaagctgaggtgggagaatccccatctgtctgggcaacatagtgagaccctgcctctagaaaaacaaactaacttagctgggcatggtggtgcatgcatgactgtagtcctagccattcaggaggctgaggtgagagggttgtctgagcctgggaggttaaggccacggtgagttatgatcacatcactacactccagcctgggttgtctcaaaaaaaaaaaaagg

SEQ ID NO: 28784 - DNA, 113 bp, Homo sapiens
ctacccaggcctactgaaacaaactctcttggggtgaggcccagagatctgttttaacaagcctttcaggtagggctgccagcttttagcaaatatttcatggaacatacacc

SEQ ID NO: 28785 - DNA, 287 bp, Homo sapiens
  misc_feature 233, 266, 281: n = A,T,C or G
ggccccctcggagctttttctccgttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaanagtcccttaccatgaccccagatttaaaatctntggagtggaatgganctttct

SEQ ID NO: 28786 - DNA, 473 bp, Homo sapiens
gctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagcttggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatg

SEQ ID NO: 28787 - DNA, 196 bp, Homo sapiens
catgcactatatttgtatatattttatatgttcatattggattcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggcc

SEQ ID NO: 28788 - DNA, 469 bp, Homo sapiens
gggacagcgtatctgtaccgtgctctaaataacaaaagctaggatgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttcttggttc

SEQ ID NO: 28789 - DNA, 195 bp, Homo sapiens
aaagtaaagtgagtgtcagtagatgtgttttttacagtctggattttaaaaaaagtggggcaggagagagggaaccagggaaagggctgtttagaaatacagtttgtggctctgagcgatgccaccggcttcctctacagagactgccagtttccctttttctttgcaaggtgtgtgtggttttaataaataact

SEQ ID NO: 28790 - DNA, 432 bp, Homo sapiens
  misc_feature 2, 7, 20, 98, 140, 155, 158, 164, 193, 231, 250, 373: n = A,T,C or G
cnccccngggaaattcggcnttatggccggggaggcattgaggcagccagcgcaggggcttctgctgagggggcaggcggagcttgaggaaaccgcanataagtttttttctctttgaaagatagagattaatacaactncttaaaaaatatagncantaggtnactaagatattgcttagcgttaagttttnaacgtaattttaatagcttaagattttaagagaaaatntgaagacttagaagagtcncatgaggaaggaaaagataaaaggtttctaaaacatgacggaggttgagatgaagcttcttcatggagtaaaaaatgtatttaaaagaaaattgagagaaaggactacagagccccgaattantaccaatagaagggcaatgcttttagattaaaatgaaggtgacttaaacagcttaaagt

SEQ ID NO: 28791 - DNA, 468 bp, Homo sapiens
ggacagtccacttaaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcagt

SEQ ID NO: 28792 - DNA, 106 bp, Homo sapiens
gggcatggtagtgagcacctgtagacccagctactcagcaggctgcagtgagccgtgatcgtgccacttgcactgtagcctgggtgacacagcaaaaccctgtctc

SEQ ID NO: 28793 - DNA, 461 bp, Homo sapiens
atcctttacataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatacctacggtcaatgctctgaaatctgtggagcaaaccacagtttcatgcccatcgtcctagaattaattcccctaaaaatctttgaaatagggcccgtatttaccctatagcaccccctctaccccctctaga

SEQ ID NO: 28794 - DNA, 154 bp, Homo sapiens
attgttcagattaaagtgtctttctctctgtgacctgcaagtatcttaacttagcatgtgtgtccaatttccatagtgaagccaaaaattcaaatgatggttgatattggcttaggaagaatttattaatgaatgactgtgcttggtatagaac

SEQ ID NO: 28795 - DNA, 370 bp, Homo sapiens
aactgaagcctgaagttagatggagttttaactaggatgaaagtagaaagaagaggacagagtaagagagctaaaacatctcaagaaaaatcagaaaaattctaaaattaaaagattttgccagcgaagagctggtaaaggagattgagaagaagcaactagagaggtggatggcgacatagaacagcgtggtgtcttgtgatcaagagaaattttcaaatacgagagtgttgtctgctggaaggtcaagtaaattggctccaaaaaaattatcccctaagttaggcaatgtgggagtgattgagcccattagtagaacactttcactagagtgatagagacataggccagattttagagcaggagacga

SEQ ID NO: 28796 - DNA, 400 bp, Homo sapiens
  misc_feature 16: n = A,T,C or G
gatgaacctcctattnggaattttatttacaaacaccttatctattctttgtccttcctctttagagtggatgtaactgaaattcagatagctttagtgattgtctttgtgttgtctgcatttggaggagcaacaatgtgggactatacggtaaatctgaatgtttaaatttatatttaagtacttttcaaatatttaggaaaaagtattgcattgttaattttcttcaaaaatccttggcattgtatttaatttttttttaattggtgtatttaatatttgttccatttcttaacatttttttcttcattttataatgtgtattatcctatataccttatggcatttcctcctatgcttgagtatattgccacatagaagaagacaacctcatttccct

SEQ ID NO: 28797 - DNA, 416 bp, Homo sapiens
atttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacag

SEQ ID NO: 28798 - DNA, 470 bp, Homo sapiens
  misc_feature 39, 40, 77, 81, 100, 144, 151: n = A,T,C or G
gagggaaaatggactgggatagaggacagactgatagtnnctttctttcatgtcacgtgtatagagaaataattatntcanaaactcacaaacctagacntgggaaaaacagattactgtctattgtcacgcatcattttcatntgtaagncactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacct

SEQ ID NO: 28799 - DNA, 473 bp, Homo sapiens
  misc_feature 7: n = A,T,C or G
agagatnaaagctctttaagacaatttgatatcatggatagagatcaaagacatacaataaattatcatcaaatcagtgtatctgactacagccccagggagattctgtaagaactttaaattctgttgcaattttcagtgaagggtattaatcaaagagataagccaatgaacatattcagccattttgtctactgtaccttttcaaaaaaatttttttccttttctttgtttttgattttctccttttgttctttcagcatggtatctagtaatctgattaattactgacccaaaagtagtttttaatttcccttaaaaaaattattagacttgtagtagaatttttttgtgttttgttttgttttcaagcatcaagtaccacgtttttgaagaccatggcctatcatcattatgcatccaagatttgagtttgaataacctcatcaagacttagatcttcttcagaagct

SEQ ID NO: 28800 - DNA, 193 bp, Homo sapiens
aagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttatt

SEQ ID NO: 28801 - DNA, 271 bp, Homo sapiens
agggtgacctagtttccaaccataaataagtagtattgtaatattaaaggaaaactgttccaatcatttaaaagtacttattaagtactgctttttacagttatgacaactgtttctttctatgcatataaatcaaggaaccaaatatctgtagccatggaaatgtctgactagaaatatttatattgaattctgaatacaaaatgtccctgtggtagaaaacttactctttatgcctggtgcagtataattcccaagtgtactgtctacc

SEQ ID NO: 28802 - DNA, 156 bp, Homo sapiens
  misc_feature 30, 79, 154, 156: n = A,T,C or G
cgatggtagtcgcacgtagctctaccatgntgaccacgggtgacggggaatcaaggtttgattccggagagggagcctnagaaacggctaccacatccaaggaaggcagcaggcgcgcaaattacccactcccgacccggggaggtagtgacanan

SEQ ID NO: 28803 - DNA, 263 bp, Homo sapiens
caaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttct

SEQ ID NO: 28804 - DNA, 472 bp, Homo sapiens
ggttgtgttgaatgaggagattggcagaattgacaaaagcaaaatgaaacaatctcagcattctggaaaaattgagcaggggcatacaacaatctgagaagtatttatgcctgtaactgctgaatttcaggtgagaacagtgagactgtatggcatttggcctggagctattcctatgccctctcccatctgtttggtaaagaggttctgtccagccactgtcagctgtgaggaccaacagcttcgctgtgtgggtgaaaaggaggactgttcattttagagtggtagcaaccctgcctgtggtcttgtagatgagagtgacagtcttggagatgggcaagtggggagacacagcggctctgttttagcccaaggttggggcaagatagaaaaactatttgaagaaataatgggcaaaaacatacttgaggagaaactcatccaggaatcccaacaaaccctaaatagcata

SEQ ID NO: 28805 - DNA, 472 bp, Homo sapiens
agatgaattttgattgctctcatttgtgttttgcttgtaaaaatgaattgttttccactggatttctggctgcttttgcaaaagtcagctgcgctggcagactgggcctgcatgtcctcctgcaggcagctagagtgagggagtctaatggacaggatgccccaagtgcccccgttgctcatggatgcccctgcctgcctctcatgagcacatagtcctgtcccctggtctagataagcccagctttcctggtacccttcatcacctggcagacagacagccccatgccaaccctggacattacttgcttttgaacctttcctttctcaacaaccatgaacttcaaatgctttctgtctcaggacactttagaataacaatggaagccatcacttattgagcaccccttatgtccatttattcaaccaatgattatttagggatctcttattgagcaccaggcagcatcctg

SEQ ID NO: 28806 - DNA, 124 bp, Homo sapiens
  misc_feature 29, 124: n = A,T,C or G
atccaaagtctggtacaactgtccttagnactgatgagcaaaggaggagtcaactaatgaagaaatgaataataaattttgacactgaaaaacattttattaataaagaatattgacatgagtn

SEQ ID NO: 28807 - DNA, 472 bp, Homo sapiens
  misc_feature 39, 65, 80, 95, 103, 127, 136, 139, 179: n = A,T,C or G
gatctatcctttacggcaagggtacctacggtacctganaacaacgatggcatggaaaacacttnccatttacctgttgntgctgctgtctgttntcgtgatncagcaagtttcatctcaagatttntcaagctgngcngggagatgtggggaagggtattctagagatgccacctgcnactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaag

SEQ ID NO: 28808 - DNA, 190 bp, Homo sapiens
  misc_feature 5, 17: n = A,T,C or G
acccngggaattcggcnttatggcggggtacgactcttagcggtggataactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcc

SEQ ID NO: 28809 - DNA, 178 bp, Homo sapiens
ctgtttttggtggctcaaatctttggtggcacataagctgctgtctcctattgaagttaaaattcacaagtgccattgaagagcttttcagctgaagcacatagcatttatccaaactagagaccttgaaagccggtgattagggtggattgtgtacacattcattccaagtttagac

SEQ ID NO: 28810 - DNA, 473 bp, Homo sapiens
  misc_feature 20: n = A,T,C or G
tacccaaaggattataaatntgctattataaagacacatacacacggatgtttactgcggcactattcacaatagcaaagacttggaaccaacccaaatgtccaacaatgatagactggattaagaaaatgtggcacatatacaccatggaataccatgcagccataaaaaaggatgagttcatgtcctttgtagggacatggatgaaggtggaaaccatcattctgaacaaactatcgcaaggacagaaaaccaaacaccgcatgttctcactcataggtgggaattgaacaatgagaacacttggacacagcatggggaatatcacacaccgggacttgtcgtggggtggggggagggggtagggatagcattcggagaaatacctaatgtagatgacgagttaatgggtgcagcacaccaacatggcacatgtatacacatgtaacaaaccttcacgttgtgcacatgta

SEQ ID NO: 28811 - DNA, 133 bp, Homo sapiens
  misc_feature 14, 38, 45, 51: n = A,T,C or G
cgatggtagtcgcngtgcctaccatggtgaccacgggngacgggnaatcanggttcgattccggagagggagcctgagaaacggctaccacatccaaggaaggcagcaggctcgctaattacccactcccgac

SEQ ID NO: 28812 - DNA, 180 bp, Homo sapiens
ctgcaaaggggcgtcggacaagtgcagctgctgcgcctgatgctgggacagccccgctcccagatgtaaagaacgcgacttccacaaacctggattttttatgtacaaccctgaccctgaccgtttgctatattcctttttctatgaaataatgtgaatgataataaaacagctttgacg

SEQ ID NO: 28813 - DNA, 370 bp, Homo sapiens
cataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgcc

SEQ ID NO: 28814 - DNA, 222 bp, Homo sapiens
  misc_feature 24: n = A,T,C or G
ctggtgatagctggttgtccaagnatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 28815 - DNA, 473 bp, Homo sapiens
  misc_feature 28: n = A,T,C or G
caattacagaagactttctcccttattncgtgctttttcctttagaaattctgcattggcccatacatttgtaaagttgttttctgaagttgtatgacacaagggagccatagacttaactgttttacttcctagcctgttctaggctagtattttgtgatagtaatctattcaaatggagtggtagaaatcacatgaattttggaagcaaatggtaccgtaagtaccacagcaaattccttctggtcattatacaggcgtacctcagagatactacaggttaggtttcagaccacatcaaaaaagcaactattgcaaatagagtgagtcacatctagtttttggtttcccagtgcctataaaacttgtgtttatactacagtcttaaatttctaaaaaatgtacataccttaagaatactttattgctaaaaaatgctaacaatcatctgagccttcagcgagtcataatct

SEQ ID NO: 28816 - DNA, 467 bp, Homo sapiens
atctaacagcaggcaggagggaacgagacagaagcaaaggcacgtcccatcctttaaggatgtttcctggaagttgcacctcctgctcctacttatattctactggccagaatttagttctctggctacattttgcggcagagaaggctgggaagtgtaatctttattctgcaagactgtgtgcttaccaaattgagagttattattatagaagaagagagcagatattggaggacaaatcttttcctccacactactcattcttgaaagatcgtgctgacaggataggctctgcagccagcctgctggagtttgcattctggatccatggtttcgtagttctgtgaccttgttgaaaagctacttaacttctctgtgcctcggcttcttcctgttctctcctgttttatagacttacaagggttgttttgagcactagttgagttaagctaaagcacttggaacag

SEQ ID NO: 28817 - DNA, 206 bp, Homo sapiens
  misc_feature 205: n = A,T,C or G
cagtgctcccatacccaatgatgatgatgttcactttagaatttcagatgataaaatctttactgatatttttcactacctggaggtgttgtttcgcattattaaacccaggaaagtgttctttatggctgtagatggtgtggctcctcgagcaaaaatgaaccagcagcgtgggaggcgttttaggtcagcaaaggaggcgganc

SEQ ID NO: 28818 - DNA, 431 bp, Homo sapiens
agcttcatttgtgtcaatgggcaatgacaggtaaatttagacatgcactatgaggaataattatttatttaataacaattgtttagggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagaga

SEQ ID NO: 28819 - DNA, 472 bp, Homo sapiens
caccatctggggaggagccagcctcctgtccacctacctgcagagcatgcgggacctcctggagatgaccgactggccctgggacttcttcatcaacctgagtgcggccgactaccccatcaggacaaatgaccagttggtggcgtttctctcccgataccgagatatgaatttcttgaagtcacacggccgggacaatgcaaggtagcacctcaacccctacccctgtacaaaatggaaatgaaaatctgagtgatcatttggggaattttctaggctggtttcatgcagccacagaaaggttgagggtgggagaaaggcttggcaccagctgtccttcgctgtgtctgcgtgggatctgaagtagtcccttctgtcagccaaggacaagataaccatagatgtttctcatggtgtgacagcccttttgattacttcccccaaggacttccacaagtccaatatctcattg

SEQ ID NO: 28820 - DNA, 471 bp, Homo sapiens
gctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcat

SEQ ID NO: 28821 - DNA, 427 bp, Homo sapiens
gattgcagaattccatatttgctcaacaaaatgatcaggtaataatgtttatattaagaggctggaattatattctgcttagttatatctcaatacagactatatccagattatagaattttagggaatgttctaatctaaaccaaaataatccaatagaatctttttttgacagtcctctgttaagatggttgtctattctgaacaccaagtaaccgctgccttgaccatcaggctcagagttgttagggggaaacaggtcattaggtgggggaggagagatggaagatgctgtggtagttgtttttctcttaaagatttaaacgagatataacatacctacagtgaagcattcctagtagtgtttatttgcccttctgagctttacttagattttgagtggttaaactaaaggagagaaatttag

SEQ ID NO: 28822 - DNA, 242 bp, Homo sapiens
gggaggctgaggcgagtggatcacctgaggttgggattttgagaccagcctgaccagcgtggagaaaccccttctctactaaaaatagaaaattggccaggcgtggtggcgcatgcctgtagtcccagctgctcggtaggctgaggcaggagaatcgctggaacctgggaggtggaggttgtgttgagccgggatcgcatcattgcgctccagcctggacaacaagagcgagactccatcac

SEQ ID NO: 28823 - DNA, 169 bp, Homo sapiens
  misc_feature 5, 17, 24, 27, 31, 64: n = A,T,C or G
ctgtnaaggatgttcgncgtggcnacnttgntggatgacaacaaaaatgacccaccaatggaancagctggcttcactgctcaggtgattatcctgaaccatccaggccaaataagcgccggctatgcccctgtattggattgccacacggctcacattgcatgcctgt

SEQ ID NO: 28824 - DNA, 467 bp, Homo sapiens
cacctagcttttaactgaaaggtgggtatattttgaatccctaaatcaagaagtcccagagcagctttattatcaaacttggaatccagcattcatcactgtgtttcactcttctatgttggaatattaacagcactggagtcccataaattatgtatttgttgctgaatgttgctgccagctatgagtggcaaagcagttccttatgtagcttattttggttttacaagatcattgatgtgtatcaagatggctcaacaaatgaaatgtagttcaaatcatagagttacgagtctgtgcaactagattgatttttcttgcccttgagtgtcacagtggtggcactctatactttaaaaagtgtgaaataacaaccaggagagatagggaaaacccaattggcttttaaaaaaatgaatacatgtcaaagattttatattaggcattaattaataattaattaactg

SEQ ID NO: 28825 - DNA, 211 bp, Homo sapiens
tacctgaggtaggagttcaagaccgtctgcccaacatggcgaaaccccgtctctactgaaaatacaaaaaattagctgagcgtggtggtggtgggcacctgtaatcccagctactcaggaggctgaggcaggagaatcccttgaactcgggaggtggaggttgcagtgagccgagatcgtgccactacactccagcctaggtgacaagaac

SEQ ID NO: 28826 - DNA, 273 bp, Homo sapiens
ggggctggagctcctaaatattattttggtcatttgcccaaaaactgaagtacaccaccaatgtcccaattatgaagttgaatacagaattataaaaaaaaattgttgaaagtcaataagaataaatcttagaatttggactcctgccacatggcagaaaaaaagcatgatgttttaaaacaacctggcctttgtccaacatgatgtttaccagattgctgacattttctagcataacaatactattcatcattgggataaccaaaagaaggg

SEQ ID NO: 28827 - DNA, 313 bp, Homo sapiens
  misc_feature 4, 15, 101, 151, 159, 180, 192, 245, 270: n = A,T,C or G
atcncagtctctgcngttggttttatttggaggtttgtgggctttttttaaaaaaaaaaagtcctcaaatcgggaagaaacatcaaagactatgtcctagnggagggagtaatcctaacacccaggctggccgccagctggcacctgcctntatcccanactgccctcgtcccagctctntgtccaactgtngattatgtgatttttctgatacgtccattctcaaatgccagtgtgttcacatnttcgctctggccagcccattctgtntttaaagcttttgaggcccaataaaatagtacgtgctgtctgc

SEQ ID NO: 28828 - DNA, 473 bp, Homo sapiens
  misc_feature 16, 17: n = A,T,C or G
attccttggccttgtnnacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttat

SEQ ID NO: 28829 - DNA, 152 bp, Homo sapiens
  misc_feature 34: n = A,T,C or G
cgatggtagtcgccgtgctctaccatggtgaccncgggtgacggggaatcaaggttcgattccggagagggagcctgagaaacggctaccacatccaaggaaggcagcaggcgcgcaaattacccactcccgacccggggaggtagtgacat

SEQ ID NO: 28830 - DNA, 468 bp, Homo sapiens
atttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaaaatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattg

SEQ ID NO: 28831 - DNA, 131 bp, Homo sapiens
cagttctctgggaagtggtcagcgcatcctgcagggcttctcctcctctgtcttttggagaaccagggctcttctcaggggctctagggactgccaggctgtttcagccaggaaggccaaaatcaagagtg

SEQ ID NO: 28832 - DNA, 106 bp, Homo sapiens
aacccaaataacccaggagaatcacttgaacccgggtggcagaggctgtagtgagccgagatcccgccactgcactccagcctgggtgacatagtgagactgtctc

SEQ ID NO: 28833 - DNA, 342 bp, Homo sapiens
  misc_feature 261: n = A,T,C or G
aaataacgcctgtcaattgaatatatagaattgaccttaatttttgaaccttagtttatactgtcacaaacatagtataaaggcgaatttatatggtatgtgtatatatataatttgtatgatatgtgtgtatatatatatatatatcaaacaccatttagtatagcaaaaatggtataaattaatgatataattctaaaagtgaacagaaaaacattacagagtatagaaaaaaagaatatattcatgattttgtagtanacaaatacaatttcaaaaaaaatacagaagctctaactgtaatggaaaaacattaataacctcaaaaacatcaattggtct

SEQ ID NO: 28834 - DNA, 473 bp, Homo sapiens
  misc_feature 103, 122, 132: n = A,T,C or G
atagcaatgatgtactttaagggaactacccaactatgttgtgatagaagaaagaggaaccttcactttggcatttttttttaatcactgtttatttttctgnttgcggcccaggaagcagngggaggtggnggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaaagatgtgagctgcttactgatcatatatgcata

SEQ ID NO: 28835 - DNA, 468 bp, Homo sapiens
ggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacgggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttg

SEQ ID NO: 28836 - DNA, 473 bp, Homo sapiens
gctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgc

SEQ ID NO: 28837 - DNA, 315 bp, Homo sapiens
  misc_feature 4: n = A,T,C or G
gacncgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttt

SEQ ID NO: 28838 - DNA, 272 bp, Homo sapiens
cacagcctcttgagtagttggaactacaggcgtgagccaccacgccggctattttgtattttttgttcgagaccagcctggccaacagggtgaaaccccatcgctgctaaaagtacaaaaaattagccgggcatgatggtaggcacctgtaatgccagctatttggaaggctggggcaggagaatcgcttgaacctgggaggcggaggttgcagtgagccaggattgtggcattgcacttcagcctgggtaacaatagcgaaactgcgtctc

SEQ ID NO: 28839 - DNA, 472 bp, Homo sapiens
gaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcggacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaac

SEQ ID NO: 28840 - DNA, 431 bp, Homo sapiens
gggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttg

SEQ ID NO: 28841 - DNA, 472 bp, Homo sapiens
ggagcatttaagaagcatcctctgccaggaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgaggtgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagacattagattctat

SEQ ID NO: 28842 - DNA, 421 bp, Homo sapiens
ggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccggtgtgatgaagccccaggactcgggaagcagtgccaatgaacaagccgtgcagtgagacccccaagaggcccatttcccccaataaaagagatttgggag

SEQ ID NO: 28843 - DNA, 268 bp, Homo sapiens
attaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtacccc

SEQ ID NO: 28844 - DNA, 457 bp, Homo sapiens
  misc_feature 10: n = A,T,C or G
gcgcaatagnatatagtaccgcaagggaaagatgaaaaattataaccaagcataatatagcaaggactaacccctataccttctgcataatgaattaactagaaataactttgcaaggagagccagagctaagacccccgaaaccagacgagctacctaagaacagctaaaagagcgcacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 28845 - DNA, 450 bp, Homo sapiens
aaggtattgaccatatcctgctaagtaatgctgtgactgattgacaatatcgtggttggatctaaagctagatgaccctgtcagtagggaggcaatagtggggagaaacatttctgccctagaaagatttcctgtctattctaccaagttactctgtgttgctcaaagtaggataattccaggtgaccaggtcatatgaaattatatgttaaagaatttgaattttaatggcataaaatgctagattatattatgtacataacacttttatctacacactaaaaataaaggtatttgataatatttatcagtgtttgattcttcaaggaggggcctagctgccatggctaatgcctgtaatctccgcactttagtagactgaagtgggtggatcgcttgaggccaggagtttgagatcagcctgggtttcatagtgagaccgtatctcta

SEQ ID NO: 28846 - DNA, 220 bp, Homo sapiens
gattctactgaaggaagaacgccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaac

SEQ ID NO: 28847 - DNA, 405 bp, Homo sapiens
gggccatttggaagttaacaaaactggaatttttaatctctcagaaaaatcttagcttttataaatgtcctactcaaacatgactagctctcattttgattagcatcatatattaagaacaaatcctatttgcttttcagtcatatttttccagcttaaatcttactataaggggaggacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttac

SEQ ID NO: 28848 - DNA, 255 bp, Homo sapiens
tatatagaaaaatccaccccttacgagtgcggcttcgaccctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactgaact

SEQ ID NO: 28849 - DNA, 397 bp, Homo sapiens
gaacgtgtgccagtaatcttcaaaagcagaacatatcacctctgccccgtaaactgttctctccgagggaaaaaatggaagttatcctcacagttcactgccgtggtatttcttctgtcccatgctttgcatgactgccatggtacagccttgtttcaaactgttcactgtgatctgtgggtctttgagtttcagtgagtttgctgaaatgtcgaagaagtagttccaaacttcaatgttcaatgaaatttttgttcaagtttgaaatggagagagcagctttaaaaggtactaagccttttacaaattggtgagtactggcacatgagatctagagcaggagcaacttctcacacatagtaagtgggaaaagaaagtgctttgaaagttcctccct

SEQ ID NO: 28850 - DNA, 472 bp, Homo sapiens
gttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagctgcggtgggtgtcatcaaagcagtggacaagaaggctgctggagctggcaaggtcaccaagtctgcccagaaagctcagaaggctaaatgaatattatccctaatacctgccaccccactcttaatcagtggtgggaagaacggtc

SEQ ID NO: 28851 - DNA, 433 bp, Homo sapiens
gggggtgaacccagtcccgaggcactactggccagtcctacaaccagtattctcagagataccatcagagaacaagcactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttg

SEQ ID NO: 28852 - DNA, 383 bp, Homo sapiens
  misc_feature 11, 381: n = A,T,C or G
tagagtaaganacagcatcaggatcagctccaatagtgtgcgttggttcctcatggcaagtgggtctgtctccccagcagccgctgcagggtggtttgcctatgagcacccatcttgtgctacagtggaacggtgtgcctggtctctgtcacttgctggcctcaagtaagacccattttcatgcagtgccgaacaattcatgacactgctgacaatgagattgtttaaatgaggtcattgtctgagagaaattaaacagttatagatagatacctaggttgtagttacatggtgtgttcattctgaaaattcattaaactgtgcccttgtcatttgtacacttttctgttatgttttattaaaagttaaaaggttctatanag

SEQ ID NO: 28853 - DNA, 117 bp, Homo sapiens
aatgccccaactaaatactaccgtatggcccaccataattacccccatactccttacactattcctcatcacccaactaaaaatattaaacacaaactaccacctacctccctcacc

SEQ ID NO: 28854 - DNA, 284 bp, Homo sapiens
ctcagcctcccgggtaactgcgattacaggcacccatgaccatgcccggctaatttttgtatttttggtagagatggggtttcaccatgttggtgaggctggtctcgaactcctgacctcaggtgatccacctgcctcagcctcccaaggtgctatgattacaggcgtcagccaccgcatccggccaacccaggccttttataactgttttcagagagagagaagagaaaacaagaaagaacaactctgaccatggtctaagagccaggtttctgtcactaagc

SEQ ID NO: 28855 - DNA, 240 bp, Homo sapiens
gatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtc

SEQ ID NO: 28856 - DNA, 470 bp, Homo sapiens
  misc_feature 23: n = A,T,C or G
gagtggagtgaggggtaacaagnatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataag

SEQ ID NO: 28857 - DNA, 219 bp, Homo sapiens
gaggcattgaggcagccagcgcagggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagc

SEQ ID NO: 28858 - DNA, 245 bp, Homo sapiens
  misc_feature 2, 53, 55, 62, 163: n = A,T,C or G
ancctagcaataatccccatgcctccatatatccaaacaacaaagcataatantncgcccantaagccaatcactttattgactcctagccgcagacctcctcattctaacctgaatcggaggacaaccagtaagctacccctttaccatcattggacaagtngcatccgtactatacttcacaacaatcctaatcctaataccaactatctccctaattgaaaacaaaatactcaaatgggcct

SEQ ID NO: 28859 - DNA, 473 bp, Homo sapiens
ggaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtgggaagaagtgggggggga

SEQ ID NO: 28860 - DNA, 375 bp, Homo sapiens
gtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcaac

SEQ ID NO: 28861 - DNA, 471 bp, Homo sapiens
gttattgtatttagtggaactatttgaaatcctactctgaaccatgttttctccaactagcctaaatcaatgtaagatgtcctgaatacgtgttttaaaatctcatttttacaaaggaaaaaaggcatcagatagagtctgagtcggtctgatgcagttgagaactgatgagacatttgtgggttttattttctgaagtggtgtttcaaatatttaatagtgagtaaaatcccttcccccatccttttaaacccagctggagcttccaattctgaagtcttttcagactctactaatttttagcaattcatttccagaaaacactcattgtacattctcccctctccttgggacatttgtctaatgaattataatagattaatgaattgcaatgttaagtcttggtatttgatattatgatgctcttaatttgaatctcattttatcaaggtgtacattctataataattt

SEQ ID NO: 28862 - DNA, 471 bp, Homo sapiens
gcatttaagaagcatcctctgccagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagacatttagattctatta

SEQ ID NO: 28863 - DNA, 472 bp, Homo sapiens
tagctcatcacactctgcctttttaaaaacaccttttgatagaaaactttttgcaaatttaattttttaaaaataacctgctgactcactggtttgtaatggaggacagagtcctttctagatcctcgaatttcgtgcctgtctccaaggcacatccccacatcccgtcacagtgctgcaggattagggaggattgcttccagctgaaagagatgggaggccgtaaaggctctctcttctggatgacgttggaaaggaagaaacatggagttagaaatgcttatgtctccacacgtagcctcttcctgggcaaccctggacagtctctgtctgccaaggtgatcattgtacttgcaaatttacctaacctgttgactgcctgtgttacatttactattgaaccagctagagttcaaaattaacctttgatcactgactttcagtttgaaccaaaaaaataaaaagaggaaag

SEQ ID NO: 28864 - DNA, 204 bp, Homo sapiens
  misc_feature 28: n = A,T,C or G
tatggccggggttgttcttaggcttctntctttgctcaaattgttgaaggatggtgatttgtttcatggtttttgtatttgagtctaatgcccgttctaacatgatagaggcaatgcattattgtgtagccacggttttctggaaaagttgatattttaggaattgtatttcagatcttaaataaaatttgtttctaaatttcg

SEQ ID NO: 28865 - DNA, 481 bp, Homo sapiens
atggccgggggaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttgggttttactaaaaaacgcaacaatcagatacggaagacct

SEQ ID NO: 28866 - DNA, 480 bp, Homo sapiens
  misc_feature 2, 14: n = A,T,C or G
gntttcctcttgcncaatttgctaacatttaaaaaattttcctgcacccagtagtttcatatcctgtagacatcctcttaggacattctcaaatttcaaaataaaaaatattcatctatgtagttaattaaagttaaagtttttgcagatcaactactcaaactactaaatacatttacctgagaaaaagtctctgagagcacttcattcctgttttagttcgtgtaaattctctgagaatgttctggagatagataactcatttacagtggtttctattaactaattaaagtacccatgattttttccttttctgctcagggatgatgggagatttccttttaccttctgaggtagaattttttaatggggaaaataggccttttaaatattattgccagggtctgcaatataacttaaaattcctgtacatactgcaaatatttctttaaatcgcacaggaaaatgagcgaacttttt

SEQ ID NO: 28867 - DNA, 472 bp, Homo sapiens
  misc_feature 74: n = A,T,C or G
ggaattagtccgagtggagagagcgagctgagtggttgtgtggtcgcgtctcggaaaccggtagcgcttgcagnatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaaggatggcaatggctatattagtgctgcagaacttcgccatgtgatgacaaaccttggagagaagttaacagatgaaagaagttgatgaaatgatcagggaagcagatattgat

SEQ ID NO: 28868 - DNA, 217 bp, Homo sapiens
gaggcattgaggcagccagcgcaggggcttctgctgagggggcaggcggagcttgaggaaaccgcagataagtttttttctctttgaaagatagggattaatacaactacttaaaaaatatagtcaataggttactaagatattgcttagcgttaagtttttaacgtaattttaatagcttaagattttaagagaaaatatgaagacttagaagagt

SEQ ID NO: 28869 - DNA, 191 bp, Homo sapiens
  misc_feature 4, 11: n = A,T,C or G
actnaaaaaanttaaaaattaaagaaaaacaatgctagaaaaatagaaactttttacttaccagcaaccccgttaaagagggtgaaagagaagccatagactgagagaaatctttgcaaatcacatgtccaacgaaggcatgtatagacaatgtattaagaactctccaatctcaatagtaagaaacaatc

SEQ ID NO: 28870 - DNA, 221 bp, Homo sapiens
  misc_feature 23: n = A,T,C or G
atttttatttgtaaagaataatnacttagatattattctaagacaattttagaagggaagttaccttcttgatttttccccttctctgtaatcatttagatcaggaattggcaaacgggtcaggaattaataacctcttgctttgggtgaaatccagaccactagtctatttttgcatggcagtgagctaagaatgttttctttacatttttaaaaggttg

SEQ ID NO: 28871 - DNA, 162 bp, Homo sapiens
  misc_feature 11: n = A,T,C or G
cgactcttagncggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccg

SEQ ID NO: 28872 - DNA, 253 bp, Homo sapiens
caccaattaagaaggcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattacccccactgtcaacccaacacaggctt

SEQ ID NO: 28873 - DNA, 276 bp, Homo sapiens
  misc_feature 271: n = A,T,C or G
agtatattccgatctgctcctccaacattgccctccacccattttgagtggatgaccatgcttcattcgtagccacacatctagaagttgccaagtagcaaggagttctgtagaaagttcatcttcaaggtgaacagaaacatctactgagcagttttttaaaatgttgttaacaactcctcaaggtaaaatcatttgaattatacgtataatgctgcatatttacattaatgtggaacaactcagaaaataataagggaggccccttagnatttt

SEQ ID NO: 28874 - DNA, 184 bp, Homo sapiens
  misc_feature 183: n = A,T,C or G
ggggggagggatagcattgggagatatacctaatgctagatgatgagttagtgggtgcagcgcaccagcatggcacatgtatacatatgtaactaacctgcacaatgtgcacatgtaccctaaaacttaaagtataataataataatataaaaaaaatttcaaagcctggttccttgcatatnt

SEQ ID NO: 28875 - DNA, 376 bp, Homo sapiens
  misc_feature 21, 171, 213, 220, 237, 248, 285, 325, 329: n = A,T,C or G
gtatatatatatatatgtgtntatatatatgtatatacatatatgtatatatacgcacatatatatatgtatttaaaaaaatcaaaacaaaaaaaactcatttatacctgtgtattttttaaagctacaatctgttcaatgtttttaaaaatctgtttatatgacattgcnaaaataaagttggtcttttgacgagagggaggatgtcacggncagttgnaactttgccttcacaangcaactggggnggggggtgggggtagtgtgcctccttggcatttcgtncaagttatagattcaatggagctatgtcttgttttaagtngctntaatgcattgtattagatcttcaaacagaataaaggttgttttgaat

SEQ ID NO: 28876 - DNA, 473 bp, Homo sapiens
agacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgaggttttgtcattaaaacagccacctttgtattttataattttatgacagaaatgaagtcattttgaatctacatgaatgaacactttggat

SEQ ID NO: 28877 - DNA, 476 bp, Homo sapiens
  misc_feature 12, 15: n = A,T,C or G
atcttttaaganttnaaactagtgtattcacttaccctagttcattataaaaaatatctaggccttgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttattgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacatta

SEQ ID NO: 28878 - DNA, 496 bp, Homo sapiens
  misc_feature 6, 15: n = A,T,C or G
cggggnaattcggcnttatggccggacaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaaccctgaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggca

SEQ ID NO: 28879 - DNA, 339 bp, Homo sapiens
atctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgtaacgcattcatgaatttccagtgttcagtaaatagcagctatgtgcgtgcaaaataaaagaatgatttcaga

SEQ ID NO: 28880 - DNA, 476 bp, Homo sapiens
agtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgaatttattcccttttttttctctagaggaag

SEQ ID NO: 28881 - DNA, 186 bp, Homo sapiens
ctaaaatacatgtgcatttatttgcacagaaaaaaacaggctgggtaaagtagctcatgcctataatcctagcactttgggaggccgaggcgggaggattacttgagcacaggagttcagggctagtgagctatgatcatgacactgcactccagcgtgggccacagagcaagaccttgtctcaag

SEQ ID NO: 28882 - DNA, 476 bp, Homo sapiens
agagatgaacaaggagacattacaacaatactgcagaaactcaaaggatcattagcgactactataagcaacaatatgcaaataaattggaaaatctagaagaaatggacaaactcctagacataaacaacctaaacttgaaccatcacaatatccaaaacctgaacagataaataacaactaacgagattaagccatagtagaaagtcactcagtaaagaaaagctcaggatctgatggcttcactgcttatttctaccaaacaattaatgatgatctaataccatttctactcaaactattctgaaaaatagagaagggaatacttccaatcctattctatgaggccagtattatcctgataccaaaaccagacaaagagacatcagaaaaagaaaactatagcccaatggctctgataaatgttgatgcaaaaattctcaacaaaatactagcaaaccacattcaacaacaca

SEQ ID NO: 28883 - DNA, 471 bp, Homo sapiens
gcttttcgatccgcctctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaaagaagtcttacaccactcccaagaagaataagcacaagagaaagaaggttaagctggctgtcctgaaatattataaggtgggatgaagaatggcaaaattagtcgccttcgtcgagagtgcccttctgatgaatgtggtgccggggtgtttatggcaagtcactttgacagacattattgtggcaaat

SEQ ID NO: 28884 - DNA, 473 bp, Homo sapiens
gtatatttcttaattttaaccctaagactagaagcaataacattttaatagcaatcagcacatctagcattcaaatcttggattcacttttttcttctttaaaaggatacagagctccttggatcaatgcctgattctaggtgcatgcggcagaaagaacaaaatgggtctgagacatctgttgttgttaagaaaataaggaagtctcaactaatgattgagacatgccaaagaacataggagctaactagaagtggctctcagtgacccaaactgagataaattgaacaagggaataaataatgatggcaatagattattcagattaattaaaccaaatacacatgaatccacactaatataaataaataattggataaataagaaaagtgggacaaaggaaagcttttccatacagtagaattctaatcaataaatatagaaagaatagtggaaattaggattctcatttt

SEQ ID NO: 28885 - DNA, 183 bp, Homo sapiens
ctgtgttttcacacaaactgctagaatttttaatgttaagacgaaaacatctgaagttctccatggcaaattgaatttttcagtcattttcttttctttttttggtacaattacttcatctggaatgtcttcattgaactcgttattctatttttcttagaattaaaagtggattaatgtggg

SEQ ID NO: 28886 - DNA, 453 bp, Homo sapiens
gttttaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcattagattctataaattcttacttgtctaagacaagtaaatctgtgttaaacaagtagaataaaagttaattcaat

SEQ ID NO: 28887 - DNA, 476 bp, Homo sapiens
  misc_feature 394, 423: n = A,T,C or G
atagtggtctgtgagctgcccatggaagtcgattatttcaggtagtcaccacgtaagtgactgtcattcaatgcagtgatttcatgagtgcaatatttcttagtgtagacgaactttacagtgataatcactaggagaatgttcacaattaggtaaaacattcatgaaagagtgctcccccactctgtttgcttttagatttaaatgatgggggtagtatctcgcttctgtttcatgtcacgctggtattgaagagagcagaaaagagattatgttttgtttgataccttaagaatgatgcagaacatatgcttaatgtccatgttttaagaataatctgaagcagtgtagcacaaaaatggtctattatttcaggcctaatattttttatatngtatttctattttgggaaatattattttnaagaacattgctttaaaattattcagtattagactgtcttctctgacttagta

SEQ ID NO: 28888 - DNA, 356 bp, Homo sapiens
ggataacatatctattttttttcctcaaattactttttaccggggctgatgtatctaaagtgctgaaaaaaaaagactgtaatagaagaatttcacatccagcaaaactacatgtcaaaaatgaaggaaaaattaaacactaccagacaaacagaaactgagagaatttgtctctatcaagactgccttacaaaacgtattaaaaggaatccttcatacagaattgaaaggatgaaaggacaatagggagtgcttgactccacgggaataaataaagagcattagtaaaggtaactgcataagtaaatataaaaggcagaataaaagtatttttaaataaaaggtatccatattag

SEQ ID NO: 28889 - DNA, 472 bp, Homo sapiens
ggaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagc

SEQ ID NO: 28890 - DNA, 149 bp, Homo sapiens
  misc_feature 5: n = A,T,C or G
tagcnaggtgtggtggcgcatgcctgtaatcctagctacttgggaggctgaggcaggagaatcgcttgaacccgggaggcggaggttgcagtgagcagagatcgtgctactgcactccagcctggtgacagagcaagactccatctcag

SEQ ID NO: 28891 - DNA, 477 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaat

SEQ ID NO: 28892 - DNA, 222 bp, Homo sapiens
cagagaacaaaagaattgcaaaatgtattcagcaccaaacaatgctaaaccaagaaacatccaatcacaaaactaggaagtttggcaagaagtggttagagaaatctctgggcttttccatgggcagggtcgacagactctcttttcagtgatttctggctctgagaaacctctttactcactagaaaagaactttatttaaatggccaattttgttcctcc

SEQ ID NO: 28893 - DNA, 252 bp, Homo sapiens
atagcgaggaagacattgaccgctgcgtggaggccttcgtggaagtggggcgactgcacggggcactgccctgagctctgggtaaggacgagaagagccaaggtccgcctactgccacagggtcaaaggaggttttcgatcagcccagaccagaggctctgagccctgaaccaaagtcccagagctgggctgggacgtgacctgtgctgagggctgtgagaatgtgaaacaacagtgtgaaaattggctgtg

SEQ ID NO: 28894 - DNA, 472 bp, Homo sapiens
atgaacaaaataataaccttttgaccctgaccttgctgggtgaattagctctgaaacactctctacaaccagtaatgcatttgtcccacatttcattctgatagaaaatgaacaccatagcaccaaacaaaaatccgaggcgttagataatgtctggattaaataatttaagactctctaggattttggttgtcattttttatttataacagactttaagtcactttctgttgcctcataggtcacattttagacaggtttgtgtctgttccttgcatctgaattcctgattgtaaagacacctatgaggtctcttagtttttgtcattcattttcttggtttatcacccctcccttctttttgttgtttttccctgactgttaagcagtttcatctttgcttttgttaaatatttgacagcagttagtttgttgttaagctcttgaaacttgtgattgtactttctgtgta

SEQ ID NO: 28895 - DNA, 416 bp, Homo sapiens
  misc_feature 354: n = A,T,C or G
atatttggagggctgtcaactaaattagtttatcctgaagagagggttggaatgagtctagtgaaggggagttgggaagaatgttgtggagtactttgaacgttagaaatcttgccggtcatggtggctcatgcctgtaatctcagcactttaggaggccgaggtgggcggatcacctgaggtccagagtttggatcacctgaggtccagagtttgagactagactgcccaacgtggagaaaccccatctctactgaaaaaaacaaaattagccgggcatggtggcacatgcctgtaatcccacctactcaggaggcggcgacaggagaatcgcttgaacgctggaggaggaangtttgtgggcagccaagatagcaccattgcacttcagcctgggcaacaagagcaaaactcta

SEQ ID NO: 28896 - DNA, 465 bp, Homo sapiens
  misc_feature 12: n = A,T,C or G
acagcacggaanctgaagctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtga

SEQ ID NO: 28897 - DNA, 364 bp, Homo sapiens
ggggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttattgtagtgcttaataaaaataaaatg

SEQ ID NO: 28898 - DNA, 268 bp, Homo sapiens
ggtggcttacgcctgtaatcccagcactttgggaggccgagatgggcggatcacctgaggtcgggagttcgagacgagcctgaccaacatggagaaaccccgtctctactaaaaataattttaaaaaattagccgggcatggtggcgcatgcctgtaatcccagctattcaggaggctgaggcaggagaattgcttgaacagaggttgcagtgagccgagatcgcaccattgcactccagcctgggcaacaagagcgagactccattc

SEQ ID NO: 28899 - DNA, 419 bp, Homo sapiens
gtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagaagtgtgaccaaaagttacatgtttgcacctttctagttgaaaataaagtgtatatttttttctg

SEQ ID NO: 28900 - DNA, 471 bp, Homo sapiens
ctacctaagctctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaag

SEQ ID NO: 28901 - DNA, 465 bp, Homo sapiens
  misc_feature 31, 36, 37, 38, 41, 47, 49, 59, 72, 134, 156, 178, 207: n = A,T,C or G
ggaaagtgatactgaaatacctaaaggccgnggaannnagnggtgtngnaagtaagcgnaaccttgagtggnaacagaactcgattaaaattacaatgggaaacatttttgaaaagctctttaaaagtctactngggaaaaaaaaagatgcggatncttatattgagtttggatacanctggaaaaacacaccatcttgtataaatngaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagagctatcagcttcccagttcgcacaattcatcaagaaattatgcggggtcacctggcacaaatgatgaggcatctcctggaagcttaacttcttatccatcccatctct

SEQ ID NO: 28902 - DNA, 467 bp, Homo sapiens
  misc_feature 402: n = A,T,C or G
caacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacggactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcaagtatggnctaacactggcatgttcaaagccacattatttctagtccaaaattacaagtaatcaagggtcatt

SEQ ID NO: 28903 - DNA, 182 bp, Homo sapiens
gttttacaagtgaagagttatgcaagacagtattttaaaaataaggtcaaatgcggtctggataaagaaacaccaaatcagaagaccggccataatcttcaagttaaaaatgaagataaagggacaaaggcatggacaccatcatgtttaaggggacgtgctgatcccaacttgaatgctac

SEQ ID NO: 28904 - DNA, 463 bp, Homo sapiens
  misc_feature 1: n = A,T,C or G
naacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaac

SEQ ID NO: 28905 - DNA, 382 bp, Homo sapiens
ggtgctgtctttatttttaaagtgacagcacatctttgcctattttttagggtacattgaagacctgggaaatatttctgtggaaattattcctgaaatccctttgaagtgtttgcactttggctattgtgtgaagaatggaaaatcgactgaagtggcattgggttggggttagtgcctgtgtaatcagatgctaatgtagctgccctgctaccagccccatatcacatcctcctcctaccacttaccataaaattgcagaggatcagctgtgtacagtaggaggtcggcagttcagttctgcacaatgcagaataaatcactgagaaatcaataaacagcagctgacaagaccaactataggaaaattaaaggctgacga

SEQ ID NO: 28906 - DNA, 168 bp, Homo sapiens
  misc_feature 15: n = A,T,C or G
ggagactaacttgcnaattctgtgaatgttattgaatatttaaaaagctgggtctgtaatgggaggcattttattagctgttgtgattgggtaacatgtccccttagatttcctgatttaaaattatacaaaattactatttttgataaaataaaggaacacctacag

SEQ ID NO: 28907 - DNA, 473 bp, Homo sapiens
  misc_feature 437: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggttcctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttaaaagttgtaggggattaaaataattttgnaaggcgatcttttaaaaagagattaaaccgaaggtg

SEQ ID NO: 28908 - DNA, 468 bp, Homo sapiens
gaagacatttttattttaccaatatatttgattctctttatttcccaaagattattaaagtcccatgaattaaaaggtgttaaagtttttatttttctgacaaaatattcaatttaagtgcttatttttcaagccaattaattagagctcttttctatgcatatcacacatacaacacacaaaaatacacagacagaagacccagtagctgttaattttttcatttgccagcttttaagaatcttaattggattactggcttcagggtggagcaacgtgtggggacagagccgggaaaacatgcagtttctggggcctaataaacaggtgcagttagaaggcaaaacagattccccaaaattacagatctcatttttatatttggattctggatcccaaaaagagggaatcagcccatcccctctgggagttttgggaaggtgtaagaaaaaatgtttccataccttc

SEQ ID NO: 28909 - DNA, 150 bp, Homo sapiens
  misc_feature 21, 24, 48, 56, 62, 75, 88, 90, 112, 132, 140: n = A,T,C or G
cattctcagggtatttatccnaanaaattaaaaaaagtaatgagagcntttattgnactgtntatatattatagnatatgtctgaatntngaaaatgtaacattaactaatntataaaaaatattctatgtnatgcaaantacttgaagc

SEQ ID NO: 28910 - DNA, 146 bp, Homo sapiens
cgggcgtggtggtgcatgcctgtgatcccagctactcaggaggctgaggcgggagaatcgcttgagcctgggaggcagaggttgcggcgagccaagatcgtgtcattgcactccagcctaggcaacaagagcgaaactctgtctct

SEQ ID NO: 28911 - DNA, 276 bp, Homo sapiens
gtgagctggcatgaggacctgttggaagtgggatccaggcctggtccagcctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcttgaacctaggaggaggttgtcacagtgaaccaaggtcgcaccactgcactccagcctgggtgacaaagtgagactctgtctcg

SEQ ID NO: 28912 - DNA, 460 bp, Homo sapiens
atttctaatatagtttacatttattaagttataacgtatgacatttttcccaatatcatttttcatacattttaattacttaatgttttaagagttctcttccagagttttgcttttcaattacgtttaaagactgtaaataacaaacagtaaggctgggattacaggcatgagccactgcgcctggcctttcctcactcttaaatgaaccccagagttcatttaagaatgaactcttcctttctccttcctttctccctccacttccctcttcccaccaaaccgggcaaatggcagatggtcacagcctgcaaactgttctgtaaatgaattttaaccagcagggactggagaggtggcagcttgagtctctgcttcaacctcctcttcttctggatcatacagggaagctgatggcattctgaaacctcttcccaagaaaagcattgacacagggatg

SEQ ID NO: 28913 - DNA, 109 bp, Homo sapiens
aacgcaggagtccgagtggagagagcgagctgagtggttgtgtggtcgcgtctcggaaaccggtagcgcttgcagcatggctgaccaactgactgaagagcagattgcc

SEQ ID NO: 28914 - DNA, 119 bp, Homo sapiens
  misc_feature 4, 16, 18, 19, 30, 34, 40, 44, 50, 62, 69, 92: n = A,T,C or G
tganactacacttctntnntgtgcctttgngganttctgnggancaactngtgagtcgtganataacanacttgacttttctagcccagcgntgatctaagaagcagaggccatcccag

SEQ ID NO: 28915 - DNA, 211 bp, Homo sapiens
  misc_feature 211: n = A,T,C or G
gaacgtctggatgctcttcttctggaaaaagcagagactgagcaacagtgtctttctctgaaaaaggaaaatataaaaatgaagcaagaggttgaggtaagtcaatattttagtgttcttttcttttttattaacatatagtgtagtcattaattttagaggtaagactttaaaaagcatctaatctgattaatattttataatataagcn

SEQ ID NO: 28916 - DNA, 216 bp, Homo sapiens
  misc_feature 5, 14, 27, 50, 186: n = A,T,C or G
tgcgnccgggaacnatacggtttcttnatggcccgggggcaaccctcaanaagccctgctccatccagggctccaatgacgtggagatccgggcagagggcaatagcaggttcacgtacactgccctgaaggatggctgcacgaaacataccggtaagtggggcaagactgttatcgagtaccggncacagaagacctgacgcctgcccatgattg

SEQ ID NO: 28917 - DNA, 293 bp, Homo sapiens
  misc_feature 2, 27, 164, 242, 261: n = A,T,C or G
anaatcggttcattaggccgggcgcantggctcacgcctgtaatcatagcaccttgggaggctgaggcaggcagatcatgaggtcaggagatcgagaccatcctggctaacacagtgaaaccccgtctctactaaaaatacaaaaaaaattagctgggcatggnggtgggcacctgtagtcccagctactcaggaggctgaggcaggagaatggcacgaacccaggaggcggagcttgcagngagctgagattgtgccagngtactccagcctgggcgacagagcgagactcc

SEQ ID NO: 28918 - DNA, 325 bp, Homo sapiens
  misc_feature 89: n = A,T,C or G
cattttagaattctatttttctttatttctgaatattgtacctcttttttccaaggtcaacacaagataaagttcattccagaaatggngggcccaatattagaaatgacattaattcccgagacggagctgcgcaaagccaccatccccatcttctttgatatgatgcagtgtgaattccattcgacccgaagcttccaaatgtttgaaaatgagatcatcaccaagctggatcatgaagtcgaaggaggcagaggagacgaacagtacaaagtgttatttgataaaatccttctggaacactgcaggaagcacaaatacctcg

SEQ ID NO: 28919 - DNA, 103 bp, Homo sapiens
  misc_feature 9, 19, 29, 30: n = A,T,C or G
accgggaantcggccttcnggccgggggnnggatcatctgagatgatggaaaatttgatttttgctttgggtgggctcctcttggggatggattatggaattt

SEQ ID NO: 28920 - DNA, 268 bp, Homo sapiens
  misc_feature 15, 268: n = A,T,C or G
agaagtaggcaaagnataatgatttagcaggtagctagaattctaggttaagagataaagacatctgggcagaaatgagggtgtcacatagaagacagtgaggaggtcaagctggtaagaagtacagactcatttgtttatcaatatattccactgagcatttctactactttggaatatcagcctctaagacagtaaaagtaggatgtatatactatcttagctaaggtagacctggataaattaacagagttactgactgagacan

SEQ ID NO: 28921 - DNA, 145 bp, Homo sapiens
  misc_feature 17, 145: n = A,T,C or G
gtatcagaaatttatcnatgtttacctgtttaaaatgattgtatttataaaattgtcaatatcttaatgtatttaatgtagaatattgctttttaaaataatgtttttattttgctgtagaaaaataaaaaaaaatttgattatn

SEQ ID NO: 28922 - DNA, 383 bp, Homo sapiens
ggaggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagcctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaaac

SEQ ID NO: 28923 - DNA, 477 bp, Homo sapiens
  misc_feature 53, 61, 201: n = A,T,C or G
ggaggcgcaggccccaggtccactccccagctgtgaaaggaatgaagatatanagaaacanggaagaaattgaccccgacgaagaagaaagtgccaagaaaaagcatttggataagaagagaaaattgaaggagatgtttgatgcaggaatatgatgaaggagaaagcacatattttgatgatcttaaaggagaaatgcanaaagaagcacagctgaatcacgtagaatttgaagatcaagatgatgaagccagagttcagtatgatggttttcgacctgggatgtacgtccgcgttgagattgaaaatgttccctgtgaatttgtgcagaactttgacccccattaccccattatcctgggtggctttggggcaacagcgagggaaatgttggacacgtgcagatgcgtctggagaaacatcgctggtataagaaaatcctcaagtcccaagatccaatcatattttctgtagggt

SEQ ID NO: 28924 - DNA, 241 bp, Homo sapiens
aacagctgtggaaacaaaatccaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttg

SEQ ID NO: 28925 - DNA, 472 bp, Homo sapiens
  misc_feature 35: n = A,T,C or G
acaatagattgtattttcttataatttttaaaatnacagttatactgtataatatggtattctatatatgtacatacttaacacaatcatatttaaaatgtggaagggtaaagttgcctaaatggaggtaagatttctgtatttcacttggaatgataaaatgtcaatactggtagagtgtggtaagttatatctgtatattgtaatactgagaacagccactaagaaaagtatacaaagcaatatactcaaaacgctatgaataaaggtagaattctaaaaagtgtttaagtgattcacaataagcaagcatataaaaacaggaaaaagaaacaggacaaaaacagaaaatagataataaaatggcagacttaaggcctatggtcttaatacttaccttaaatataaataatctaaatatgccaattaaaagacagattttgacagaatggatttttaaaaaatgatccat

SEQ ID NO: 28926 - DNA, 212 bp, Homo sapiens
atcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagggaagaggaagaacgtctgagaaataaaattcgagctgatcatgagaaggccttggaagaag

SEQ ID NO: 28927 - DNA, 369 bp, Homo sapiens
  misc_feature 21, 37: n = A,T,C or G
gggttccaaattactcatagnaggagaaaaccagagnaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactt

SEQ ID NO: 28928 - DNA, 477 bp, Homo sapiens
gataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtctt

SEQ ID NO: 28929 - DNA, 102 bp, Homo sapiens
  misc_feature 4, 16, 18, 30, 40, 52, 75: n = A,T,C or G
tganactacacttctntnatgtgcctttgnggatttctgnggaagcaactgntgagtggtgagataacagtactngacttttctagtcccagcgttgatcta

SEQ ID NO: 28930 - DNA, 267 bp, Homo sapiens
ggagccctggtggcctgctgcatagttttcttcgtgtctgacctcttcaagactaagacgacgctctccctgcctgcccctgctatccggaaggaaatcctttcacctgtggacattattgacaagaacaatcaccacaacatgatgtaggtgccacccacctcctgagctgtttttgtaaaatgactgctgacagcaagttcttgctgctctccaatctcatcagacagtagaatgtagggaaaaacttttgcccgactgattttt

SEQ ID NO: 28931 - DNA, 334 bp, Homo sapiens
cagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgcggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagcca

SEQ ID NO: 28932 - DNA, 338 bp, Homo sapiens
  misc_feature 26: n = A,T,C or G
ggcggtgacgacctacgcacacgagnaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 28933 - DNA, 215 bp, Homo sapiens
atcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactgaaccgaac

SEQ ID NO: 28934 - DNA, 463 bp, Homo sapiens
gaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggaacaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccaca

SEQ ID NO: 28935 - DNA, 254 bp, Homo sapiens
  misc_feature 254: n = A,T,C or G
gcagactattctgtttttgttttttatttgcagaaagatttatttttataacttgggaatatataacctgatataatagaaaatactgttttcccattgtgtgtagtatttaatgcagtaaataataaattaatactgacagtgaggccaaaaaaaatctaaatgttgctttcagcataatactttttaatgctaattaaaacagtccccatcatttgtctctgtagattattttataaactgagagctgcgcn

SEQ ID NO: 28936 - DNA, 301 bp, Homo sapiens
  misc_feature 3, 12, 221, 255: n = A,T,C or G
aantcggccttnggccgggggtcttcccacctttaccttccaaatactgggattacaggtgtgagccacgaagccgggcctggagacattttaaaatgtcacagctgtggggtgctactaacatctagtgggtagaggccaagtatgctactaaacattctacaggcacaagatggttccctacaacaaagaattattcagccccaaatgtcaggagtgtncatgttgagaagccatgacctggaggaggtatancctttgttttgacaccaccattaaagataagcctggacacctggat

SEQ ID NO: 28937 - DNA, 400 bp, Homo sapiens
  misc_feature 113, 116, 212, 242, 313: n = A,T,C or G
attcccagggctccactgctaggattcttctcactagttctaacaaaatctgtgatgttaatgactgatgctctcaattgtgatccagagttttaaataaatgaaatcaaggnggnttttgggaatatatcctgaagttaacatcttgatgtcctccttgttgtaagatgatatttggcaatttaaaatctatgtgctacccacctgggctngtctcaatccgtggactttttggtgtggcngtttcacctgaattccacacatcagatttgtttggaaatattgtactgtacagggactatgcattatgcanaaagatatagttttctttgaactgctgtaaccttaaattggaaactgattcttgtgagcctactttccttaatcccgccgcccccct

SEQ ID NO: 28938 - DNA, 165 bp, Homo sapiens
attttatggatataacaactgtctattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaat

SEQ ID NO: 28939 - DNA, 431 bp, Homo sapiens
  misc_feature 18: n = A,T,C or G
actgcccacgccaaaagnagcctctccagcagagtgagaagttctgagtttgaaactcaacttcaacaacttgctggttgtgactttgaacaatccactcacattttgtaacatctctgctttgtcatctgaaatatggcagaaataatacccatctcttgaatatatcatgagtaaattttttaatgcataaaacctccatgcttctgcatgtagtcagcatacagtaaataaagtttccttctccctaggtaagaaggactgcttcataaattataaagctttatgtgaatgcgagagattgttattaatattgtgctgcttccagattccaacttttacaaaagagttttagaaagagaaaaggaatttagtcattgtctcacaatacctggcataaataagtacacaataaaagtcaaccttctcat

SEQ ID NO: 28940 - DNA, 458 bp, Homo sapiens
  misc_feature 385: n = A,T,C or G
catttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccanggctcttctcaggggctctagggactgccaggctgtttcagccaggaaggccaaaatcaagagtgagatgtag

SEQ ID NO: 28941 - DNA, 306 bp, Homo sapiens
ggcggcgtcgccaggaaggagcgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaag

SEQ ID NO: 28942 - DNA, 308 bp, Homo sapiens
caacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttac

SEQ ID NO: 28943 - DNA, 255 bp, Homo sapiens
cagtataataaatctatacttaagttagtaatggctatataggttctatctcatggaaatacagtttattggctgggtgcaatggctcaggcctgtagtcccagcactttgggaggtcgaggcgggtggatcacccaaggggcaggagttcggagttcaagactagcctggccaaggtggtgaaaccatgtctcggctaaaaatgcaaaaaaattagctgggcatggtggcatgcgcctgtggtcccggctactc

SEQ ID NO: 28944 - DNA, 150 bp, Homo sapiens
  misc_feature 1, 147: n = A,T,C or G
nattaatgacactgtatacaataaatgtgtagtttcttaatcgcactacctatgcgacactgtgtattaggtttatcatcctcatgtatttttatgtgacctgtatgtatattctaatctacgagttttatcacaaataaaaatgcnatc

SEQ ID NO: 28945 - DNA, 298 bp, Homo sapiens
catatctaaaacccgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccaac

SEQ ID NO: 28946 - DNA, 466 bp, Homo sapiens
tactcaacactttaaacgttctcatgtgacactattcacatgatgagttctgcttaatggcatcaaaataattttttatttaacagagaaactaaagtaaaagaggggattaaattgactgttcaaatgaacagattccaatggcttatgaagtacagtaagtcaaatatgagaaagagaaatctgcaactaccagcatacttccatttgggctttggagtaaaagaagacaattttcaacaggagattcttggtcttttggctgcagtttttctatttacatacaagacttcatcaggcttttcaggcctctcaaaaaaccaggcttacagaaataattatagtaggataattcaataatttaagtttgttctagctacgtagttctatgtatgatgcatccattgctctacatatgtaaaatctattactagattaaacttgataaacacaggagtgatactta

SEQ ID NO: 28947 - DNA, 140 bp, Homo sapiens
atttggattacatgtaagttacatccatgcattctacttttcatagtgtagaatctacttcttcttaaagagctctttaaatgcacaaagtattgttagctgccagttcttggcagaaacactccatgttttgtgttgtg

SEQ ID NO: 28948 - DNA, 160 bp, Homo sapiens
gggttgatagaatagactgaaattgtattaaaaatgcaaagctgaggttgggcgcatgggctcacgcctgtaattccagtactttgagtggccaaggtgggaggatctcttgaacccaggagttcgagaccagcctgggcaacatggcaagactccgtct

SEQ ID NO: 28949 - DNA, 470 bp, Homo sapiens
  misc_feature 29, 59, 77, 153, 161: n = A,T,C or G
ggattactgatatatattacataaggttntttttgaattctgtttccataatatttgtncaaccacatgcccaggcntactccatttttctcctgttacagatgaagcactttcatccattataaaatacatttaggggactccgtatactanaaaatggnagaccaggagctaagttttaaaagacagtatcttgtgtgataaaccatgaggatattgaaatttcttgaaacttctaactggtatccaaaaactttggtatgaatgcattagcaaaattagccattcactcctttaagagagatttggagcttatcactaattcaattatttgaaccaaggaaaacatagagtgtgagagataaatgactgcaattttgctttttaaaatgcacaggcagaagagataatattctttgatgcaccattgaccctcagatacagtcaaggtgggtgtcctcattcacata

SEQ ID NO: 28950 - DNA, 182 bp, Homo sapiens
gatacatctctgtaaagggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggattacag

SEQ ID NO: 28951 - DNA, 465 bp, Homo sapiens
  misc_feature 24: n = A,T,C or G
gatctgctggtgagataaccgagnataacagggcccatggtccaggtgatccacccacctcagcttctcaaagtgctgggattataggcatgagccacagcacccagccagatctctgacttttcatatccattgtcttgtcatagaagacttaggtggtcttggacagcaaacatgccttggttctgccagctgagacccaggtgtagtacagtaaacagtgatcttcagattctgagttacaaatcctggcctcctaattcctagaatcagacttcacatgagtttcttgaaatgcatctttgctaaaaatattttataaaactgccaaagtaaagagatcttgataacatactgccatgcagagactcaggtagtacatacaaagtcctccaagtgctccaactaactcctgtgtacttggatgtaacgcctttgtacctttccatgtgatccctcatgtta

SEQ ID NO: 28952 - DNA, 434 bp, Homo sapiens
aactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcacca

SEQ ID NO: 28953 - DNA, 302 bp, Homo sapiens
gaaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtattt

SEQ ID NO: 28954 - DNA, 456 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaaga

SEQ ID NO: 28955 - DNA, 463 bp, Homo sapiens
gatctatcctttacggcaagggtacctacggtacctgaaaacaacgatggcatggaaaacacttcccatctacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcgg

SEQ ID NO: 28956 - DNA, 403 bp, Homo sapiens
  misc_feature 1: n = A,T,C or G
natttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttat

SEQ ID NO: 28957 - DNA, 321 bp, Homo sapiens
ctcggctcactgtaagttccgcctcccgggttcgggcgattctcctgcctcagccgccctagtggctgggattgcaggtgcctgccactagacctggctaatttttgtattttttgtagagatgggttttaccatgttggccaggtaacggtcaggcgcggtctctactaaaaatacaaaaattggctgggtgtggtggtgggtgcctgtggtcccagctactgggggggctgagacaggagaactgcttgggcccgtggggcggaggttggagtgagccaagatcatgcacttctgcctgggcggcacagccaactctgt

SEQ ID NO: 28958 - DNA, 463 bp, Homo sapiens
ggcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaaga

SEQ ID NO: 28959 - DNA, 460 bp, Homo sapiens
gggcgcggtggcgcgtgcctgtagtcccaaagtgctgggattacaggcatgagccaccacctccagcaataagcttaatttttttataagcaaattcttaaaatcaatgcaaacccagttgagcacctccagtttgcactgatcttaagaatttgcttatcattttctccagtgttaagtgtactgggggaaatggctgacacagctcaaaaggcttttgaacttcaggtagctccataaaatgttaataaatattatatttattacaatttaattttctctccttgttaataataaaagctcctgtctgtccctacaaccagcaagtgctaccaaggagggggacttatgcacccattagcaacacgtttactaacttgttactcactcacctttaagaactccagctctatcaaggagagaagataatcaaggagagaagggaagaaaaggattggta

SEQ ID NO: 28960 - DNA, 467 bp, Homo sapiens
  misc_feature 15: n = A,T,C or G
ctctgaaaattaagnctggccctggaaccatagcccacaaaagtagaccaggacccacatactaagcctaaacagggtgactgcctagacaggaaatcagcaaggatgtagaaggtctgaacaacacaatcaagcaacaggactaaattgacgtttctggaatacttcacccagaaaccacagaatacatagtcttccaaagaattcgtgggacattcaccaagacggcgcacatcctgggccatagagcacttttaaacaaccaaactcatgcggagtgcactctctgatcgtagtggagtctattagaaatcagtaacagaaagacaacaggaaaaccttcaaacaggtaaaaatgaaacaacacactattaaataatacatgatttaaagatcaagttttaaaggaaataaaaatacataaaactgaaagcaaaaacagaacataccaaaatatttgggacgca

SEQ ID NO: 28961 - DNA, 464 bp, Homo sapiens
acatcagcaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgcta

SEQ ID NO: 28962 - DNA, 108 bp, Homo sapiens
  misc_feature 4: n = A,T,C or G
attnatgttgcagcatataacagtactgcgttcctttttctggctgaataatattccactgtatggatagaccccattttgtttattcacacatcatttggacatttg

SEQ ID NO: 28963 - DNA, 388 bp, Homo sapiens
gaaggacttcaccaaatctgcgtgcagtggggataaccagaagctcgctaccatactggtgtgtgtaagattgatgtccaaactgctggtaaacacaagcaaaggaaagaaactaagatccaagtgtcccattaggtgttccaaacaaactataatgtgaaactgatgttaagtacattttgataagagatcagtactgaaaaactcatgttgtggtacgttttaaattttctagtagattttttattggtgtaggcaaaaggttactatgcaagaactttaagaaaatgtttgatattgtctttaatgagtagaaaagaaaaggaatttgttcacctgtctaccaaacgaaaaaaaacagctgaaggcccctagtgattgggtagtg

SEQ ID NO: 28964 - DNA, 338 bp, Homo sapiens
  misc_feature 4: n = A,T,C or G
aaantcggtcttaggccgggggcaaagtgttaatgattgattatactgagtgttaggtctttaaaacaaatgtaatattagtaaagtctgttagaacccgatgaaaattaataaaacataatcgtaaggggtgttagtgctacagtttgttttctgttttcatatacagttaacacggctctctctccctgctacagttttcttttgatatacaggttttgccagcttttttcactagatggtgctaattccctttagggacctaggctgttttcatacgatgtttaaaatgattcttttggtagtaaaagaaaaatttgataccaatttggggattg

SEQ ID NO: 28965 - DNA, 463 bp, Homo sapiens
  misc_feature 12: n = A,T,C or G
aacataacagtnagggaagagtctttaaaatttaatccttatgattctagcaggagagaacagatggcagatatggccaaaataaaaccatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaggttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaat

SEQ ID NO: 28966 - DNA, 157 bp, Homo sapiens
aagtcataagaggagagccattatacccgttgtctttctgggctccttgagtttatctggattccaacagcacttggaaagtaccgccctccactacctcaaatgcaaacacaatctctgccagtagacattggaattagacttagtgaaaactaga

SEQ ID NO: 28967 - DNA, 184 bp, Homo sapiens
  misc_feature 2, 16: n = A,T,C or G
cnagttatttatttcnaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataac

SEQ ID NO: 28968 - DNA, 463 bp, Homo sapiens
  misc_feature 16: n = A,T,C or G
tgggagaagaaaaaangctttggaagaggaagaactgagaaatctccagagaaacgtccagagaaatctgtgaagtccacaagtgtggaagggaaagggaagtgtgattaggctgggatacagaaggctaacagtacactttatatgagaagagcttagaggtcaggagagcacaatgctgaggggtttgtttggttttattttcccctctggaaacttggagaaaggaggacaggaaaagatgataagagggcaccattgtttggttttaaaggtccctccccaaccccccacaacaagaaagctcattttaatgagatgagagaaggggagaaagctccctccgttctgatgcttttgagcttatcagggacaccctgcagcagaaattccagctgatccttcagccttcagagttgatgaggtggggctcacacacatctggatttgaagaagaatcgtg

SEQ ID NO: 28969 - DNA, 404 bp, Homo sapiens
gaactgggctttaaaaaatggtgccagaggccaggtgcagtggctcatgcctgtaatcacagcactttgggaggccaaggcaggtggatcgcttgaggtcaggagttcgagaccagcctggccaacacagcaaaactgtttctactaaaaaaaaatatatatatatatacacacacacacatatatgtatgtatgtatatgtgtatatatacatgtatatgtatatatatacacacatatatatacacacaaaagtcagccaggtgtggtggtgcatgcccgtaatcccagctactcaggagtctgaggcgggagaatctcttgaacccgggtagcagaggttgcagtgagctgagatcacaccactacactccagcctgggtgacagagtgagactccatctc

SEQ ID NO: 28970 - DNA, 161 bp, Homo sapiens
gactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccg

SEQ ID NO: 28971 - DNA, 462 bp, Homo sapiens
gtatttttcattgtatttaatactcatgtttttatgtatgcattcttcattgtgtttaatacagattttgagtgtttaactaggtgtcagagagatgcaaaaacatatacagggaaagacagggtgcggcagacagagagatttagacatgctaaggaaaatactaaagaagaagaaaaatattagatttatcctttcaaagtaaataaaactctaagagaaaaagagagaactatttgcatttataattttgtatctagtattttccctgatatactaaacccatgccagctaagctttctgggcataacattgagacacttttagcactctgacaccttcctagtatccagctccatgtgccaccctagagtcatttatcctagatttgaggtccaggaatcaaattaaccaaaggtacaaaagttcaggattaagatgagaggggagattttaacaaag

SEQ ID NO: 28972 - DNA, 463 bp, Homo sapiens
  misc_feature 18: n = A,T,C or G
ggaatcaattcaacaagnaagagctaactatcctaaatatgtatgcacccaatacaggagaacccagattcacaaaacaagttcttagagacctacaaagagactcaggctaccacacaacaatagtgggagacattaacaccccattgtcaatattggatcatctaggcagaaaattgaccagaaaggacttgaacacagctctggatcaagtgaatctcatagatatctacagaactctccaacacgaaacaacagactatatattattcttagtggcatatgacactctaaaattgatcacaaaattagaattaaaacactcctcagcaaatgcaaaataactgaaatcataacaatctctcagaccacagtgcaatcaaattagaactcaagattaagaaactcactcaaaaccacacaactacatggatattgaacaacgtgctcctgagtgacttct

SEQ ID NO: 28973 - DNA, 435 bp, Homo sapiens
gagtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagaggtgagaaaaaagttgtcttgaaggtgggggtgggggggctgctaaacagacactgtacagagggagaagagacataatttagctgtgttgctagtatgattccatttttaaaggaggggagggggagggtctagagctctaactgtttttagttgcatatggaaatatctaaaaaaatatttagcatttttact

SEQ ID NO: 28974 - DNA, 405 bp, Homo sapiens
  misc_feature 16, 21, 23, 391: n = A,T,C or G
attgtggaggcagagnaaagnanaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatttggcaaccttgtatttgngtgtatatatatat

SEQ ID NO: 28975 - DNA, 116 bp, Homo sapiens
  misc_feature 13: n = A,T,C or G
cagctactccagnagctgaggcagagaatcgcttaaacctggaggggcagaggttgcagtgagccgagattgcgccgctgcactccagcctgggggacagagtgagactctgtctc

SEQ ID NO: 28976 - DNA, 254 bp, Homo sapiens
  misc_feature 1, 212, 217, 253: n = A,T,C or G
ngcccctcatttacataaatattatactagcatttaccatctcacttctaggaatactagtatatcgctcacacctcatatcctccctactatgcctagaaggaataatactatcgctgttcattatagctactctcataacccacaacacccactccctcttagccaatattgtgcctattgccatactagtctttgccgcctgcgaagcngcggngggcctagccctactagtctcaatctccaacacatng

SEQ ID NO: 28977 - DNA, 462 bp, Homo sapiens
  misc_feature 17: n = A,T,C or G
gacaaccttagccaacntttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcgaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagta

SEQ ID NO: 28978 - DNA, 136 bp, Homo sapiens
  misc_feature 1, 3, 60, 75, 127: n = A,T,C or G
ngngaccaatatttgtattcaaattacatttcatggcttcccattgtctcacaatgagtnctaataaatgggatntactataataatccaagtatgacatagccggtatgctttcatgaatgttttnatgtagatt

SEQ ID NO: 28979 - DNA, 463 bp, Homo sapiens
gatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagttttt

SEQ ID NO: 28980 - DNA, 420 bp, Homo sapiens
gtaaacctagctagtaaatattgatgatgttcagggccactgacttgcacagcccttggagcactattcacacagaacacaattcagagtttgttaagacattaacacactttgatatctattccaaaaatacttttgttaccacaggttcattgctgtcatttagacaaaattaatgtactgtgatattttcctactcttaagatgatgttgcccagcctagtactgtcagaaattcagttctgatgtctgtgtgtgcaagatattaatgtggtccctgtaagaaataccagagttggtcatgatttactaaggagatgtaatattttctttgacctgttaggaatataacttgtgtcttgatttgttgcacatcatattttttgcaacattaatgaatttaaataaattaattggaac

SEQ ID NO: 28981 - DNA, 191 bp, Homo sapiens
  misc_feature 191: n = A,T,C or G
gtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcn

SEQ ID NO: 28982 - DNA, 427 bp, Homo sapiens
ctctgtgaatttgactactctaggtattccatgtaagtggaatcgtgatatttgtccttttatgtctggcttatttcacttttaatgtcttgaaggttcatccatgttgcggcatgtgtatcagaatttccttcctttttaaaggtgaataacattccattatacgtatacactgcattttgtttatctgttcatctgttaatggacacttgaattgcttctaccttttggcttttgtgaataatgctgctgtgaatgtgggtatacaaatatctctttgagaccctgtgttcacttttttttggtatatacccagtagtggaattactaggtcatatggcaattctatttttaagtttttgaggttagggcatactgtttttcacagcagctgcatcatattatattcccaccaacagttcagaga

SEQ ID NO: 28983 - DNA, 463 bp, Homo sapiens
ggaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagcaaaagctgatttcgaacagaaaatgacagaaacagctcagaaatttcaagatattgaagaaactcatctcattcacataaaggaaattataggatccttgt

SEQ ID NO: 28984 - DNA, 466 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccg

SEQ ID NO: 28985 - DNA, 471 bp, Homo sapiens
  misc_feature 5: n = A,T,C or G
aaagnaaagtcgtaaaccctactgttagaactgtagccagctgtgacctgcaactaccacctgctggcctggaggttgacccacacagcccattacaacatctgcttacataagtgcacagcacttgggaataagaaaagcttctcatgacttcttttaccaccattgctcatgccaccccagcttctcaggaggttatgagccagctcacccacccgatacaccactactgtaaccagcatttgagaaagccaccacactaaggctgtttatatccaaggaaatcctagaatatttgctactgaacacactcagaagcaaagtcaaacaatcctactcaaattacatcatagtaacatcctcaggattaaaaaaagtccactccagaactcccattcacaattgcttcaaagagagtaaaatacataggaatccaacttacaagggatgaaggacctcttcaagaagaac

SEQ ID NO: 28986 - DNA, 313 bp, Homo sapiens
  misc_feature 6, 24, 58: n = A,T,C or G
tgaggnccggggacaatgccaggnatcctgtacctctacttcagcaattacctacagnattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgcttcctggaccgcgaatcagtgtgttg

SEQ ID NO: 28987 - DNA, 355 bp, Homo sapiens
  misc_feature 2, 60, 87, 100: n = A,T,C or G
gnatcgggggtggtgggagaagcagaggcggcgactcacttataaatggcgccgaagcangacccgaagcctaaattccaggagggngagcgagtgctgngctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacaga

SEQ ID NO: 28988 - DNA, 109 bp, Homo sapiens
  misc_feature 25, 26, 27: n = A,T,C or G
ggggaatcagggttcgattccggannnggagcctgagaaacggctaccacatccaaggaaggcagcaggcgcgcaaattacccactcccgacccggggaggtagtgacg

SEQ ID NO: 28989 - DNA, 156 bp, Homo sapiens
gtttgaaagagtattggtgttctggagtgggggtcaacccctccccagtctctgtgctaagttcacttgggaggatgtaggagccagggctggccatgggtcccctacccttccccgtaggatataccctggagaatggcaaaatgatttaaagag

SEQ ID NO: 28990 - DNA, 468 bp, Homo sapiens
gtgcaaaaccatctgtgactgaagaaaaaaacatggaacctgagcaaccaagtacctccaaaaatgttaccgaggaagagctggaagactggttggacagcatgatttcctaaaaaggggaaaaaaagtgcctgaagcaaatcttggttgccttctaacggcaggtgggcataaggctgtccttcaggaccagccagtttacaagcatgtctcaagctagtgtgttccattatgctcacagcagtaaatgcctacctctgtgtttgacatctgaaagaatacattgaagcagcttgttgcatttgtttttctggcttagtaatctaatagatttccttaagggcaggagatagactctggcccttgtttctagcctccttccttgcagtgtttacaacatagccagtgtttacagcatagcagatgctgctgctgattaagagaatagatgcaaacaaggcatgcatt

SEQ ID NO: 28991 - DNA, 469 bp, Homo sapiens
gtacagggcaggttgtgcagctggagacagagcagtcctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgaggcaaaagtactttgtcggttacctaggagagagaacgcagagcacccctggctacatatttgggaaacgcatcatactcttcctgttcctcatgtccgttgctggcatattcaactattacctcatc

SEQ ID NO: 28992 - DNA, 469 bp, Homo sapiens
atagccgaacctaccgtctttccctgatcattgaaccttctgtcttctgcagtcagcagaccgtctctaatgagaggtgcacagacacttttgatgcttattttaagggaagccagtggcagatggagagccatcagatgaaactgttattaatcacaccatttctgaagctgttctgactccacaccctgcattgtgacaaacgccaggatgccaagttcctagtattgcagcaggttcttagtacataacaaacactatcagtgcccccagctcaacttcgactaaatgccttccaatagagttaagctgtttttatctaatacatgctaacagtaaaaggacacagaccctcttatttgaccctcttagcatctaaggaatatgatactttttttctttatacttagctgtgtattcaaagctaacacattctctaagtaaccaagttcacactaaagaaaaattg

SEQ ID NO: 28993 - DNA, 149 bp, Homo sapiens
atttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttac

SEQ ID NO: 28994 - DNA, 371 bp, Homo sapiens
  misc_feature 1, 6, 285, 288: n = A,T,C or G
nttttnctcccagggaaattcggccttatggccgagaaaagcctgccggagatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattggnagnatttgcaatgtgcgcaattttttttgtagttgtggcatcttgttgacatcgaatatgactttgataataaataccggttcctg

SEQ ID NO: 28995 - DNA, 210 bp, Homo sapiens
cactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctcc

SEQ ID NO: 28996 - DNA, 278 bp, Homo sapiens
cgtggtggctcatgcctgtaatcccaacactttgggaggctgaggtgggcagatcacgaggtcaggagttcgagactagcctggccagcatggtgaaaccccgtctctactaaaaaaaatacaaaaaattagctgggcatggcgatgcacacctgtaatcccagccactcgggaggctgaggctggagaattgcttgaacccaggaggcagaggctgcagtgacctgagattgcaccactacactccagcctgggcgacagagcgagactacatctca

SEQ ID NO: 28997 - DNA, 465 bp, Homo sapiens
tatcctgaacctccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatg

SEQ ID NO: 28998 - DNA, 171 bp, Homo sapiens
atcagagaattctgtaaacacctctacgcaaataaactagaaaatctagaagaaatggataaattcctcgacacatacactctcccaagactaaaccaggaagaagttgaatctctgaatagaccaataacaggctctgaagttgagccaataattaatagcttaccaacc

SEQ ID NO: 28999 - DNA, 471 bp, Homo sapiens
  misc_feature 11: n = A,T,C or G
agctatggagnatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctg

SEQ ID NO: 29000 - DNA, 441 bp, Homo sapiens
  misc_feature 14, 107, 182: n = A,T,C or G
atctcagaaaagtnaggcagttatgatctttaattacgatcgagaaacttaaatatacattactctgcttaacagagaagccaacctactctggacttttttttggnggggtagtttaactgaaggaaatgtatgataaatgtggtatcttaagtattattgtaatgtattaccttcattgnggattgagttccagtaaattgaagataaaggatagtggaatgtatagttttgctaatgtggcattgctagagcagtttatttccattttacaatacaaaattatacaagatgattgcaaatattattgtatcagcctcacaaataaaatgtatatgtaaagtgaaaaatgtggcattctctttacccttagtattgttattggaatattttggtggctgagtttagaattgaaacttctttgggtccagtggtgctcac

SEQ ID NO: 29001 - DNA, 462 bp, Homo sapiens
aacattagtagtagtaaaactaatgccttctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccg

SEQ ID NO: 29002 - DNA, 323 bp, Homo sapiens
  misc_feature 5, 288, 323: n = A,T,C or G
caagnaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggngctataataaataaacttcaacactctttatgatn

SEQ ID NO: 29003 - DNA, 165 bp, Homo sapiens
  misc_feature 164: n = A,T,C or G
cgtacgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcnt

SEQ ID NO: 29004 - DNA, 464 bp, Homo sapiens
ggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttc

SEQ ID NO: 29005 - DNA, 462 bp, Homo sapiens
aagaaaaggaagtacatctatagccgaattgataaggttattactgtgttttgcacaaagtatattagcaaaagtatttgctggaattattggtagatggcagtcccactcctacacctgctctgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagctaccaagctctcctggtaatgtttgtggctatatcatttacacaaaacttttcaggaacttctgtgttgtttaagcaagatgtatctgtactgatgtc

SEQ ID NO: 29006 - DNA, 201 bp, Homo sapiens
  misc_feature 201: n = A,T,C or G
aaggtattattgctgtacttcttttctgttaccttacgaagttgattgttgttgaagcaccaacagtatgcatacatgggtatccagaatgaccatctagtctcagttgtgcaaaattcactatgtagtctcatggattgagaggggcaattagcaagagtgtgagataatggagaacaaaaaataatgccaagctgggtn

SEQ ID NO: 29007 - DNA, 462 bp, Homo sapiens
  misc_feature 15, 16, 36: n = A,T,C or G
actcgaggagccgannacttatttagcctacagagnagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaactttgaagttttggattttacttatt

SEQ ID NO: 29008 - DNA, 489 bp, Homo sapiens
  misc_feature 1, 33, 77, 185, 186: n = A,T,C or G
nagattcgctgtggttcacttgcaagctgcctngaaggtaatcacgtgatgctaaacttgtagtaacttatcaaaanattccatcagttttactttgaatattacgagggatttaggagagcaaaagttgattactttggaaatgtaaacagcttaaacccggattgtaaaatcagaagcctggnntgattacaggtacatgaaaagagttggttatttatatcatttgttaatgctgggagtgaattttgagaatgaagatttagtgtcatgttagagttccagcacagtaaatttattgttgctggtcagtgagtgaatgtgccattttgctaagacatggaaacttaaggtaactgctggaaatccagatattgaaactcttctagcatatccacccttgaaagcaggttagtatgaagagccaactgtaatgacatggagtttagccagagtagtacacatgaaccttttgaggattaaaaaact

SEQ ID NO: 29009 - DNA, 222 bp, Homo sapiens
caaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcactac

SEQ ID NO: 29010 - DNA, 375 bp, Homo sapiens
  misc_feature 7, 21, 267, 329: n = A,T,C or G
aggaaanaaactgcatcaacnaacgagcaataatcaccagctaacatcataatgacaggatcaaattcacacataacaatattaactttaaatgtaaatggactaaatgctccaattaaaagacacagactggcaagttggataaagagtcaagacccatcagtgtgctgtattcaggaaacccgtctcacatgcagagacacacataggctcaaaataaaaggatggaggaagatctaccaagcaaatggaaaacaaaaaaaggcnggggttgcaatcctagtctctgataaaacagactttaaaccaacaaagatcaaaagagacanagaaggcccttacagaatggttaagggatcaattcaacaagaggag

SEQ ID NO: 29011 - DNA, 439 bp, Homo sapiens
  misc_feature 10: n = A,T,C or G
agagcccagnatatatggtcaaatgattttagacagggcaccaaaacagtttaacagtgaaaggagactctttgacaagtggtgctggaaccactgaacgttcagtagaatgttcaaaggtatttgatgcctacctactttatggcatataaaaatactaattcaaggtgaatcacagacctgaatattcgctacaacgatcatactcctaagaaaaataagagtatcttcatgagcttgggtaggcaaagacttcttaaagagcacaaagaaagcattaactataaaacaaaaattcataaattggatttcaccaaaactaaacccttcttctcaccaacagatactactgagaacaggcaagctatagagtgggaaaagatatgtgacacataaatctgacaatcctttatgtccagaatgcacaaaggagtcctat

SEQ ID NO: 29012 - DNA, 352 bp, Homo sapiens
  misc_feature 1, 11, 23, 68, 72, 95, 108, 126, 129, 165, 195, 204, 222,230: n = A,T,C or G
naacatgcatngattactaacangatatggcttcatcgacaaggaagatttgcatgatatgcttgctncctntagggaagaatcccactgatgcntaccttgatgccntgatgaatgaggccccanggnctcatcaatttcaccatgttcctgaccatgtttggngagaagttaaatggcacagatcctgaaggngtcatcaanaaacgcctttgcttgctntgatgaanaggcaacaggcaccattcaggaagattacctaagagagctgctgacaaccatgggggatcggtttacagatgaggaagtggatgagctgtacagagaagcacctattgacaaaaaggggaat

SEQ ID NO: 29013 - DNA, 488 bp, Homo sapiens
  misc_feature 33: n = A,T,C or G
gaattcctgaagctgacagcattcgggccgagnatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgcccgcatttggatttggatgaattccaaattctgcttgcttgctttttaatattgatatgcttatacact

SEQ ID NO: 29014 - DNA, 286 bp, Homo sapiens
  misc_feature 13: n = A,T,C or G
gtttttttaaagnctctcgagtccataaaagaactccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctgc

SEQ ID NO: 29015 - DNA, 284 bp, Homo sapiens
acttttgagccctcatcaagctctcattgtgatgggagggatacctttttgttgttaaaagcctattattgttaaaggccttttatggaaaccaacttggaaaacaaccttaaatgtggatgtatcagatttggtttatccagccatgggagagaaaacaaacctaagtttactttacttgtacatatacactacaatggatagtatatttgctgtaaactacaatgtaaaacctcaataaaagtgcgctgtacttcttaatgtttattaaaagatgtattttt

SEQ ID NO: 29016 - DNA, 461 bp, Homo sapiens
cagagatgagttcctatgtatgtcctttgttccttcaatagctaattaatgtgcttgaggatacttcagtggaaaaaaaggtttaaatatgcaaattactaataaatgtgtaacccttatgtaacttgtgttacatcaagtaacaagctaatctagtttgtttcactggactaggcttgtgctccctacttcagtattttgatgctttccttgatctttgtttcacaaaatgttgtgaattttggtatcattcaaaacaaatgacatttattaggtttcattttgaaacgatgtacagacaagtccccaacttagaaaccggtttgttcttaaggttcttgcgtcagcccatggaagcccactgacctccaccacagcccaaatggagggctgtggtggccagatctggttggcttttgtgggctgacccagacatttaatcaccatctcttatgttgttg

SEQ ID NO: 29017 - DNA, 466 bp, Homo sapiens
ggaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccattaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcatt

SEQ ID NO: 29018 - DNA, 431 bp, Homo sapiens
atctccctcatcctgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccatgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtaattagatatttaagtcacatgt

SEQ ID NO: 29019 - DNA, 271 bp, Homo sapiens
gttcaaaattcacgatcaatgcctccactgagatctttcaccactccctctttgaccagctttaagaggaacttggtttccgttgtcacattatgcatggtctgaaagttcatagcagccatgcattgactgtcgaggtagtgcaaaggtgttctgggttgattgaggtcatatccaaaacccgccaaactgacttcatcgcacagatgtgtggctaagacaacggcaatgacaccgattgtggggacgttctgagaaagggaaaagaaga

SEQ ID NO: 29020 - DNA, 464 bp, Homo sapiens
  misc_feature 6: n = A,T,C or G
gaggcnttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaac

SEQ ID NO: 29021 - DNA, 264 bp, Homo sapiens
  misc_feature 12, 19: n = A,T,C or G
cattggaaaagnacatagnaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttac

SEQ ID NO: 29022 - DNA, 404 bp, Homo sapiens
  misc_feature 403: n = A,T,C or G
accccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccacttctggtggttgccactcatctgaggctgtgagtcttgcctggacaggcttttggggacagggggcccaaggagcagtagagggcaatcgttaagattgtggatggactgttgggtactggtgaaggattctggatttggccgggcacagtggctcacgcctgtaatccccacactttgggagaccgaggcaggtggatcacaaggtcaggagatcgagaccatccaggcaaacacggtgaaatactaaaaaatnc

SEQ ID NO: 29023 - DNA, 382 bp, Homo sapiens
caatgtacctttgaaaagaccactaatttagaaaacaaagctaagtgcagtcattacaagaagcaaagaaatacttaagttagaaaaaaattaaaatgaagggatggtctaagttttcttcatgctggaacaaatgttaaagaagcagtgattgcttacaatgtatgtgataaaataatacctttcacaatcaaaattttaatagtaaatataagataaaatttatattaaataatgaaaacgtatttgtactgaatttagtcactagagaacatcgtaacaaaatacatgaaacaaaagtagccagaaatgtgagaacaggtggaaatgtatacattatttgatggtttgtttttttatggaaataaacaacatacatagc

SEQ ID NO: 29024 - DNA, 216 bp, Homo sapiens
gcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 29025 - DNA, 469 bp, Homo sapiens
aaaacacaatattccttatttcaaattagtatgattcctatttaaagtgatttatatttgagtaaaaagttcaattcttttttgctttttaaaaatctgatgcttcataattttcattatattattccacatatttttccttgaagttcttagcataatgtatccattacttagtatatatctaggcaacaacacttagaagtttatcagtgtttaaactaaaaaataaagattcctgtgtactggtttacatttgtgtgagtggcatactcaagtctgctgtgcctgtcgtcgtgactgtcagtattctcgctattttatagtcgtgccatgttgttactcacagcgctctgacatactttcatgtggtaggttctttctcaggaactcagtttaactattatttattgatatatcattacctttgaaaagcttctactggcacaatttattattaaaattttgaatc

SEQ ID NO: 29026 - DNA, 465 bp, Homo sapiens
  misc_feature 12, 13, 186: n = A,T,C or G
agtcctagccgnncaatgatgtaaaaaaagaaataaaaggcatacataatggaaagaaagaagtaaaattatctctgctagcaggtaacatgatctcatatatagaaaaccctaaagattacacacacacacacacacacacacacacaaatccccattagaagcaataaatgaattcagcaaatntgcgggatacgatatcaacatacaaaaattcatttatttctatacattaacagtgagcaatctgaaaatgaaattatgaaaacaatatcatttaaaatagagtctaaaagtataaaatactcatcaataaacttaaccaaaagacttgcacactaaaaactacaaaatattactgaaagaattgaagagacaaataaataaaatgtctcatttttatggattagaagaataaatgttaaaatatcaacaccacccaaagcaatctacagatttattgca

SEQ ID NO: 29027 - DNA, 324 bp, Homo sapiens
  misc_feature 87: n = A,T,C or G
agtgaaccatgattgtatacttgctgtgttgcccaggccactgtataccagcctgggcaacagagcaagaccttgtcttaaaaacanaacaaaacaaaacaaaaggtttatggagataggaccaatatccagaatctagttcaagaagccagaataggctacagtggagttggagaatgggagataagagagcagggatcaaaagaagacatgaaaagaatcaccaggaaaaagataatggaggagaacttagaaaaagtgaaataagacaagtaacattcaacatacagtacttagggctatagaggaattataggtgtgggg

SEQ ID NO: 29028 - DNA, 490 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaat

SEQ ID NO: 29029 - DNA, 239 bp, Homo sapiens
cgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacggagctactaattctaaagcgacaactcctaaacctcaaaagccaaccaaagcacccc

SEQ ID NO: 29030 - DNA, 118 bp, Homo sapiens
  misc_feature 9: n = A,T,C or G
ggacacagnaatccgagtgatgctgtacccctcaaggatttaaactaacgaaaaatcaataaataaatgtggatttgtgctcttgtatttttaagtggattaaaaaacttactacctt

SEQ ID NO: 29031 - DNA, 492 bp, Homo sapiens
  misc_feature 2, 79, 395: n = A,T,C or G
gnatgtatgatatatagagtgtgtttctatataatatatgacattgtatccagattttaccattatttgtaagagtagngttcaacaagctactccactattactgaaagccaaaacctcaattttatattctttttggattttacataaatgacattatatagtatgtatacttttacatatactttcttttgtacatcatatttgtaatattcatcaatcctgctgtagatatgtaagtactgagattacaggcatgagccaacgtgctcagcctaaaatattttaggaggttaaggtgggaggatcacttgtggctgggaattttagaccagcctgggcaatagagtgagaccctctctctacaaaaaaattaaaaatttgccaggcacggnggcatgtgtctgctattccagctactcagaagactgaggcagaaagatcagttgagcccataagttcaaggctacaggaagcaatgattgcactcct

SEQ ID NO: 29032 - DNA, 415 bp, Homo sapiens
gattgcagataatttttagcttagggcctggtggctaggtcggttctctcctttccagtcggagacctctgccgcaaacatgctccgccagatcatcggtcaggccaagaagcatccgagcttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttg

SEQ ID NO: 29033 - DNA, 177 bp, Homo sapiens
  misc_feature 20: n = A,T,C or G
atgtgttctacatttttttntaattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatctt

SEQ ID NO: 29034 - DNA, 487 bp, Homo sapiens
  misc_feature 6: n = A,T,C or G
caaggncaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaagga

SEQ ID NO: 29035 - DNA, 227 bp, Homo sapiens
  misc_feature 20: n = A,T,C or G
atgataaaccggcaggaagnattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagac

SEQ ID NO: 29036 - DNA, 317 bp, Homo sapiens
  misc_feature 317: n = A,T,C or G
ctccaaattatagtttttgcaataatcagttttaggaaaggaagaaatgggtaagcaaagtaattcatgagtggatcctgaaatttgggatacacgttctgaagaataggatgttgtgtggtggtcactcattcattcattcattcattcagcaggcatgtatcaagttcccaacatacgtagaacactatataaggtgccagggatacagtgatgactaaaaaagaaggttttgcccttaaagagcttataatacagtaggaaaatatacgacaaccctaaagatcagtttgatgtggggtatgatagaaccattn

SEQ ID NO: 29037 - DNA, 105 bp, Homo sapiens
  misc_feature 21: n = A,T,C or G
attcatcacatttctttagtnacaaaaaatatagtaggtaaagtgctccagtagtgaaaatgattgccatttcattgtgaccactttcaagagaagtttattacc

SEQ ID NO: 29038 - DNA, 464 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgcaggtgattaaaataatttgaaggcgatcttttaaaaagagattaaac

SEQ ID NO: 29039 - DNA, 230 bp, Homo sapiens
  misc_feature 230: n = A,T,C or G
gatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccn

SEQ ID NO: 29040 - DNA, 278 bp, Homo sapiens
cactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatt

SEQ ID NO: 29041 - DNA, 297 bp, Homo sapiens
cattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgcttgccccacgtcccccaccaaagcccatgtaaggagctgagttcttaaagactgaagacaggctattctctggagaaaaataaaatggaaattgtactc

SEQ ID NO: 29042 - DNA, 438 bp, Homo sapiens
  misc_feature 6: n = A,T,C or G
ctctangcgcaggttgggtaggaaagtaacatggaccagctgagtgtagttcatacagatgtggaccagacagggcgtgagaggtggaaggagaggactggtcccaaaggccaaacaccaagactgaaaggcaagcttaggagaaatcgacactgttaggaggaattgacaaagtaaatcttatgacaaatttcaaaattaaaaaatttaaaaaccctaatagaaataaaacgtctcatttggataatgttttaaatcttctaagtgcttttctatctgtcttctcattggatcctcagattaacgtttgaagttagagtttataattattatttatctaagcttgtcagatgaagaaactaagagcctaataatttaattaaatgacttgcgtaagttttaacagctaatttgcaacagagtaaatcttatgaaaat

SEQ ID NO: 29043 - DNA, 452 bp, Homo sapiens
  misc_feature 6: n = A,T,C or G
gtatangccactaataaaatgaatctaaacattgaatgtgaatggccctcagaaaatcatctagtgcatttaaaaataatcgactctaaaactggaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctg

SEQ ID NO: 29044 - DNA, 210 bp, Homo sapiens
  misc_feature 30: n = A,T,C or G
gaatttcttcttcttcttttttaactgaangctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgg

SEQ ID NO: 29045 - DNA, 372 bp, Homo sapiens
  misc_feature 6: n = A,T,C or G
gttgcncaggctggagtgcagtggtgtgatcatggtttactgcagtctctaactcctgggctcaagtgatcctcctgcctcagccatctgagactgcaggctcgcatcgctgctcccgcctaatttttagttttctatagagatcaggtcccactgtgctatgttgcccaggctggtctccaactcctgggcttaagtgatcttccctctgtggtggcctcccaaaatgttgggataacaggcgtgaaccactgtgcctggctgggttttcatacatgcaagtttacacatgtattttatcttacatgatagactgacattcacttagacaactctagaagctaaatttgtaatctgttcagataggtgttg

SEQ ID NO: 29046 - DNA, 350 bp, Homo sapiens
  misc_feature 29, 30: n = A,T,C or G
ggtacgcccgggtggttgctgccgaaatnngcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtgtaactacaatcacctaatgcccacaaggtactctgtggatatccccttggacaaaactgtcgtcaataaggatgtcttcagagatcctgctcttaaacgc

SEQ ID NO: 29047 - DNA, 438 bp, Homo sapiens
  misc_feature 30: n = A,T,C or G
gtctcattcagttcccctaacaggtctagnagtcattatcttccccaacctaaggaaactgagacccagaggttcagagtatcccaagatcctacaggaattgcagattgtagccaaaattggaactcctaattccagagctcctccctcctgctagcatttttctttgagtagttttattaatgagaaaagctgttgagcaccagagcaaccccgcctcttctaaataccatctgacgtatacattcagcagaggaaaaatgatgtgaggtctggggcttgctttaaaatactttggggccagacacagtggctcacacctgtaagcccagtgctttgggagtctgaagtggtaggatcactagaggtcaggagttcaagaccagcctgggtaacatagtaacatagggagaccctcatctctataaaaaaatttac

SEQ ID NO: 29048 - DNA, 451 bp, Homo sapiens
  misc_feature 10, 15, 17, 26, 29, 36, 37: n = A,T,C or G
gggaacgagnaaagnanaagagtagnagnagagggnntagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccaga

SEQ ID NO: 29049 - DNA, 479 bp, Homo sapiens
  misc_feature 29, 30: n = A,T,C or G
caaacccggtatggtggtcacctttgctnnagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacaga

SEQ ID NO: 29050 - DNA, 213 bp, Homo sapiens
  misc_feature 150: n = A,T,C or G
tcgagttcccccagcctcccggtgctgcgcgctgggctgaggcccttctgcgatgttttacctggctgcggctgtgtcagatttctatgttcctgtctctgaaatgcctgaacacaaggatccagtcatctgggggcccacttgcagatnacaatgaagatggggccaaaactgctttctcctttggttaaagattgggctgccaaagcattt

SEQ ID NO: 29051 - DNA, 211 bp, Homo sapiens
catccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 29052 - DNA, 140 bp, Homo sapiens
  misc_feature 139: n = A,T,C or G
attgtgcaatacagtttcattaactccttcccccgctcccccaaaaatttgaatttttttttcaacactcttacacctgttatggaaaatgtcaacctttgtaagaaaaccaaaataaaaattgaaaaataaaaaccant

SEQ ID NO: 29053 - DNA, 456 bp, Homo sapiens
gaggccttgaggcagccagcgcaggggcttttgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaaga

SEQ ID NO: 29054 - DNA, 133 bp, Homo sapiens
  misc_feature 2, 7: n = A,T,C or G
antgacnagaaaagcgggtaccatcgaaatgcttcatgggagcaggctatgaaaatgattattaatgatccacgatacagtgctttggcaaaagttaagtgaaaaaaagcaagcctttaatgcctataaagtc

SEQ ID NO: 29055 - DNA, 427 bp, Homo sapiens
  misc_feature 6: n = A,T,C or G
caaatncaaatacctaatacatatattaccattaaacaggatagtcagcactacctagttttttagctgaatttgtaatgtccatatgtttatgtttctttagtaatacttgaactaaaggaatttgcaaagaaaacccaataatattagtattacatcaaaaagttactgtgtatttttcttccatcaagaaataatgctgacttttaaaggtggaggagttttttggacttcagtaaacataggtaccctgaaaatgtgcactgttgtatcttttcacttttgtatgtcagtgctttgaaagaatggacaatgttatcattttgttttgtctgcttattaaaattttctccctagtgtgatgtgactatcattttgccatttcagtgtcatattagaaatggttgttttatttaccaaataaatt

SEQ ID NO: 29056 - DNA, 317 bp, Homo sapiens
gacctaattaaactgaaagcttctgcacagcaaaggaaatgatcagagtaaacagtcaacccacagactgggagaaaatattcgcaaactatgcatccagcaaaggactaatatccagaatctacgaggaactgaaatcagcaggaaaaaaatgaataacccatcaaaaagtgggcaaaggacacgaatagacagttctcaaaaggagatgtacaaatggccaacaaacatgtgaaaacatgctcaacatcactaatgatcagggaattgcaaatcaaaaccacaatgagatactgctttactcctgcaagaatgac

SEQ ID NO: 29057 - DNA, 324 bp, Homo sapiens
  misc_feature 5, 15, 30: n = A,T,C or G
atctncgggaccggnatttgcacggaagcncatgcacctacccatacaccccctcttctgagcacagatgttcccccatctcgctccctcccaggactctgaccccagcattctcaggcaccagtccctgtccggaatgccacccacatcttccatttccatgtcccctcccagagctggtggacccagggaacagccactcccctccactctctaccagataactgaggaggggagaggtgggccgtaacgggcacggatcacgatgtaaattattaagcattttggttggatttcttttgtaataaactatttttgtaccac

SEQ ID NO: 29058 - DNA, 115 bp, Homo sapiens
gggtgacggggaatcagggttcgattccggtgagggagcctgagaaacggctaccacatccaaggaaggcagcaggcgcgctaattacccactcccgacccggggaggtagtgac

SEQ ID NO: 29059 - DNA, 102 bp, Homo sapiens
gctgaggtaagaggattgcttgagcccaggagttcaaggctgcagcaagctttgattgcgccactgcactccagccttggcgacagactaagacgctgtctc

SEQ ID NO: 29060 - DNA, 114 bp, Homo sapiens
  misc_feature 12: n = A,T,C or G
caatgatcaagnaataataaaatagcaatattataaaagaataatggcgaatgaattcactacctatttccagaattactctacagctatgaaaatcaagattatgtgttttgt

SEQ ID NO: 29061 - DNA, 445 bp, Homo sapiens
  misc_feature 2, 3, 33: n = A,T,C or G
tnngctgctacctgtggtgagctttgctctgtnccctgaggagatactggacacccactgggagctatggaagaagacccacaggaagcaatataacaacaaggtggatgaaatctctcggcgcttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaag

SEQ ID NO: 29062 - DNA, 445 bp, Homo sapiens
  misc_feature 31: n = A,T,C or G
cttgccaaatctgggtcatcaatcatagtanaatgttcaaaacaaataatgcatctttcatggttcactgtattcatcagcacttttgaagtcaccagtctagagtagtcgcctttggccaagttttcagtagcctgtggtttaggcaataagcctcaactgtctttctcgaggatatgttcccaggtggttgtactccatgggccattttcaatcaaatctgaaaggacaaaagggcagttctgtttatatgaaatgacatcatattataacctcaaaattgttgtcttaaaagtcaaatcattatctaaaaggtctcttagaattacttagagcttgaatgcaaaagactgaatttcccactcacgtacttcgccaacactcattacataggcaaaaaagtatagtaagtgtcacttatgtgagcctatgtatgtatgtagtg

SEQ ID NO: 29063 - DNA, 295 bp, Homo sapiens
tcttttccgtggcgcctcggaagcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacaga

SEQ ID NO: 29064 - DNA, 247 bp, Homo sapiens
  misc_feature 12, 243, 245: n = A,T,C or G
aaggccccaagnacagcaaagtactccccaggctgccaactctccacctaaccttggagcaaaaattcttcaagggtgagtagtgatttgttgaagatgtttaattataataataaaaaattattttagtcatggctcattgtttttatccctggttgtccagggaggtttttcgttagagtttctgagaaaagatggatagatgcttttgaaggtgaaaagtatagaaggcacacagagcancnga

SEQ ID NO: 29065 - DNA, 167 bp, Homo sapiens
  misc_feature 32: n = A,T,C or G
cgactcttagcggaggaatcaaagctgcacantggtattaaaacaacttgattttgcgcacacagttgcatgcatggcaagctgttaacctctgggtggcattttcattatgaatttgttcaccacctgtcttgcttaagctacaaaataaatgcatttgactgcca

SEQ ID NO: 29066 - DNA, 291 bp, Homo sapiens
  misc_feature 6, 15: n = A,T,C or G
atcctnaccaccagnagctatccacaacttcgcagaggtaacaataaatttctttttctggaatctgtttatggaagatgcaattttcttttttgatgacaaataagagaaagtaaaaacagaaccctttttcaatatcactcctgtatcaaacagatacagtgttcctgacccattgttatttgtcaatttgtccaattttgtacagccgctactttatcatatttaatacattttgtgacttgggcatgtggaacataattttgttattttcactgcttttactcccct

SEQ ID NO: 29067 - DNA, 490 bp, Homo sapiens
  misc_feature 14, 468: n = A,T,C or G
aaagacagagcagnaagccttgatgatgcctttggtggatcagctggaaaacaggcttgggggagaagagaaattccaggaacgggtgacaaagcacctgataccatgcatcgcacagttttcggtggccatggcggatgactctctttggaaaccactgaactaccagattctgctaaagacgagagactcctcgcctaaggttcgatttgctgctttgattactgtgttagcactggctgaaaaactaaaggagaattatattgtcttgctaccagaatccattcctttcttagcagagttgatggaagatgaatgtgaagaagtagaacatcagtgccaaaagactattcagcaactggaaactgtcctgggagagccactccagagctatttctaagactttctgtggtgtttcatactctactcagagttcacactcatatttcatatttttatttttggggngttgggtgccatgttacttttg

SEQ ID NO: 29068 - DNA, 316 bp, Homo sapiens
  misc_feature 6, 18: n = A,T,C or G
gtggcnattctacacagnaagattcacctgggctcaaagttggccctgttccagtattggttatgagtcttctgttcatcgcttctgtatttatgttgcacatttgaggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcggtttttttctatggctaataaactttttaattcactc

SEQ ID NO: 29069 - DNA, 472 bp, Homo sapiens
attcctcgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaaattgtatgatctggtattaggaaattactttcacagtaaatatcaaagaaaaaagattaagggtctctttgccatgcttttcatcatatgcaccaaatgtaaatt

SEQ ID NO: 29070 - DNA, 155 bp, Homo sapiens
  misc_feature 4, 5, 34, 36, 46, 63, 86, 87: n = A,T,C or G
aaannacccaagtcggcgtggcagcttttaacantnttgcaacttnctgtatttggagaagtntctgtcctaaaatgcggctgcgnntcaaagattccaacggtcatagaaacaactgttgcattcaataaaattggggtgcctaatgctctgga

SEQ ID NO: 29071 - DNA, 111 bp, Homo sapiens
  misc_feature 30: n = A,T,C or G
ctttctgagatctgcttttagtgaagtggntcaatgatgaaactagccaaatctgagcatcagaagtctttccagtctacctgatgcatgatctctacagttctgagaagc

SEQ ID NO: 29072 - DNA, 162 bp, Homo sapiens
gtacgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgc

SEQ ID NO: 29073 - DNA, 443 bp, Homo sapiens
cagctcttcagacatctcctggtttctccttgaaactctgtggtttcatcattccttcttagttgacctgcacagcttggttagacctagatttaaccctaaggtaagatgctggggtatagaacgctaagaattttcccccaaggactcttgcttccttaagcccttccggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgg

SEQ ID NO: 29074 - DNA, 410 bp, Homo sapiens
  misc_feature 24: n = A,T,C or G
ggtggctgtatttttgccccaagnaagtgtttggataaccacacaaaagcatgatgaaaaggcttcttgtagtcccataatttcttgtgaactaatgttgtgaatttttgtatacagtcacctgcatagttcctacaggctaatgtggtaaaactgttgatttcccaatttaaccttaggtttctgttgcttataagcgattcatttgctacggctggaatatgggaaaattaatttgggcttagtggttacaaatatgtgtaagtggatgtatatgtacttaaactggctttgtatatatgtataaatgctggtggtggtgaaagtagtcttgttttatgaggatgtctgcattaaagcagtaaaataagctttccattttattcataatctaatgtgtgtgtatatat

SEQ ID NO: 29075 - DNA, 487 bp, Homo sapiens
  misc_feature 7, 26: n = A,T,C or G
taccacngatcttctgatcttcaagnaagacttagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaac

SEQ ID NO: 29076 - DNA, 467 bp, Homo sapiens
tcccggcttcatttctcccgactcagcttcccaccctgggctttccgaggtgctgtcgctgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtaga

SEQ ID NO: 29077 - DNA, 163 bp, Homo sapiens
  misc_feature 24, 162, 163: n = A,T,C or G
ctctactaaaaatacaaaaattancctggcgagttggtgcatgcctgtaatcccagctactcgggaggctgaggcaggacaatcgcttgaacctgggaggtggagattgtgctgtgcaccattgcactccagcctgggtgacaagagtaagactccgtcgcnn

SEQ ID NO: 29078 - DNA, 497 bp, Homo sapiens
  misc_feature 3, 26, 36: n = A,T,C or G
tcnttttcaggacccaaacaaccgcngccgctgttnccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataataga

SEQ ID NO: 29079 - DNA, 489 bp, Homo sapiens
  misc_feature 5, 20: n = A,T,C or G
caccnaaaatatctcctgcngatttttttatgtgtttgcagcttagctttaacaaggagctgaaggacggccaggcagcaaggggtggtgagtgccggtagagtgtgacgagctcgcccagccttcctccctgtaattaggagtcatgaaccatctacaccatctcccttagctaataagagatttttacatttacttacctcaaagtgacctgtctgggttttcttttcttgtggcccccactgtaggtttttggaagaagctgaccgcctgaaaagaaattataaaacatgaaaatcgctttgaggtgaccaagtccggaggcccctaactcctcccaagctggatctggggtgtaagaactgtgacttcaggtaacaaagtagtatcccctccctgccccctgtgaactcatgattcttggtagcttgcatggcagttcttcctttaggaagtgtagtttcttccaggaactctgaaacttggggt

SEQ ID NO: 29080 - DNA, 363 bp, Homo sapiens
  misc_feature 9, 22, 33, 34: n = A,T,C or G
aagaagccnattttttcctagnacaactagaannttatgttgatactaaaggaggctctcagttctagtgatagatacttaaaaagaacaaggggtggctcatgcctgtaatcccagcactttgggaggctgaggtgggcagatcacgaggtcaagagatcaagaccatcctggccaacatggtgaaaccccatctctactaaaaatacaaaaatcagctgggcatggtggcacgcacctgtagtcccagttactcaggaggctgaggcaggagaatcacttgaacccaggaggcggaggttacagtgagccaagatcgtgccactgcactccagcctggtgacagagggagactccgtctta

SEQ ID NO: 29081 - DNA, 482 bp, Homo sapiens
accacacttagagccttctttaaacatgttaaataagagtgtttaatggctcagaatatgggataaatatagttatcagaagctatatcactatggataaaaaataagaggtgtggaaatttgataaaggaatacacttcatatcattacatgagtagaaatctcatctctaaactaaagaagaaagggaggtacagtttctgtgccctctgggaaagtattgtggttttctttacctccttcttgtgaaataaaagtcgcagaaacttcttcggaactagttgctaatagctcctcagtatattattacaaaaatgtggagaaaattagatgagaatcctatttttaaaagctgaggcaggcggatcacttgaggtcaggagttcaagaccagcctggccaacatgatgaaaccccatctctactaaaaatacaaaaattaggcctggtggtgggcgcctgtaatcccagctactcgagag

SEQ ID NO: 29082 - DNA, 329 bp, Homo sapiens
  misc_feature 172, 273: n = A,T,C or G
aaattggaatacaaatggtagagcaaaataaaatgattgaattagtttacatttactgaatttgataactgtaccatggtacataagagaatgtcattttcttgggaaatacacattaagtatttaggagtaaaagatgatgatgtttataatgtagcctcaaatagttcanaaaaaaagtgtgtgtgagtgtgtgtttgtgcagggggagatagcgtgtacaaataagcagtacaaatgttaacaggtgaatctgggtaaatggtaatgggngttcttttttattatttccatctttgcaacttatttgtaaatttgaaattatttcc

SEQ ID NO: 29083 - DNA, 192 bp, Homo sapiens
aagagccacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactagg

SEQ ID NO: 29084 - DNA, 182 bp, Homo sapiens
  misc_feature 4, 22, 32, 40, 56, 81, 115, 127, 147, 160, 178: n = A,T,C or G
catncccaggaactaataaatnagtgttgccnttatacantttgcactaaaaagantggcattattttcctcatcagtcanaatttataacagggggtggtatctagaaatactnatatatacaatnccacactggaagacactcancagttaatgaagntaattactgggccaactngaga

SEQ ID NO: 29085 - DNA, 127 bp, Homo sapiens
  misc_feature 127: n = A,T,C or G
cgaagggaacgtcatcgtttggaaagcgtcgcaataagacgcacacgttgtgccgccgctgtggctctaaggcctaccaccttcagaagtcgacctgtggcaaatgtggctaccctgccaagcgcan

SEQ ID NO: 29086 - DNA, 399 bp, Homo sapiens
cagacctctcagtaaatagtcctcttgaaggctgaagtccatgctttagactgaaaaaaagttgaacgtagcttggataaatcttataactgaggaatacatgcttaccatccaaaggttctttttaatagccaattatttattaaattgggggtttgcccggggaggtgggaggtgaaataagcaatcagcattcgagcccattccttattcagaaaaaatttttttctcttctattactggctagatctcatggaaaatcccttgaaaatgctgaaatgaacttttcctctccctctcttctggctgtttgcctttttttcataaagaatgagtgtagatttgatctgtaactattatagtttatatttgatgggaccctatggaaaactactagct

SEQ ID NO: 29087 - DNA, 102 bp, Homo sapiens
  misc_feature 1, 35, 37, 42, 52, 65, 87: n = A,T,C or G
nggagacttggtatcactctgtctcccaggctggngngcagngatgcgatcntggcccactgcancctcaaattcctgggatcaagngatccctcctgcctc

SEQ ID NO: 29088 - DNA, 141 bp, Homo sapiens
  misc_feature 6: n = A,T,C or G
agtgcngcccttacgacaggcttacgtagtagcttttgtgagatttttaagttgttatttctgattagaactctgtaaccctcagcaagtttcatttttgtcatgacaatgtaggaattgctgaattaaatgtttagaagg

SEQ ID NO: 29089 - DNA, 130 bp, Homo sapiens
  misc_feature 2, 5, 90: n = A,T,C or G
gnctngtggcctactagccctgacctgaagaaccctgtctccaagtctttggttgaagagaagatatatgactgttcgagtgtgctcttncacagaacttggttttcaaataaatataagatctccagat

SEQ ID NO: 29090 - DNA, 237 bp, Homo sapiens
  misc_feature 2, 12, 27, 28, 35, 36, 41, 42, 46, 50, 54, 71, 80, 170, 172: n = A,T,C or G
tngctttattgnacctctgtgcagtanntcattannaccannatantctngtcnataaactgtatgcgtgnctgttcttncttttgaagataaatgcaggagtcatagtgaaacaaataaaggcgagatgaaaaggttctgccattacaggaccagtaagcaaaaggagngngcagacattgtggccccggattgcatccaatgctggcagcattgcatgattctccagtatatttg

SEQ ID NO: 29091 - DNA, 412 bp, Homo sapiens
  misc_feature 31: n = A,T,C or G
cagaccgtagtggatatttatgtaaactatnactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagc

SEQ ID NO: 29092 - DNA, 481 bp, Homo sapiens
gggaccggggacctccgtcccagccctgctttaaactgaattctgccagcagcccccatgatggaggaaaggaaggatcctgccctgccagcaccttgacctctgacctccacaattgtaagcctgaggttttgtgtagtcaccatagaaaactcacacacataagaactccgtactgattcaacaatagaacatgtcacacacgaactggaaactgattctgtgggcgacaagagtctatagtaaacgttatgacagattctttgaatgcgctaatctcagactggactaaagttgggattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaatgaaaat

SEQ ID NO: 29093 - DNA, 193 bp, Homo sapiens
  misc_feature 22, 128, 162: n = A,T,C or G
tgggtccttgggcctggccagncttcctcttagcctctggatctagaagggaccataagaggagtgggccctggttcctgctgtcctggtggctgggcccagcaggggccctcactcttgaagtccangactgggtctgacctggtgggagcacctgccaanaggatgctctttcccaggacggatgggccct

SEQ ID NO: 29094 - DNA, 490 bp, Homo sapiens
  misc_feature 8, 27, 32: n = A,T,C or G
ggtcaccncgcgagcgaacgaccaagnaggtnttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtgctgttctagttgttttaatctgtctttttacattggcttttgttttctaaatgttctccaagctattgtatgtttggattgcagaaga

SEQ ID NO: 29095 - DNA, 164 bp, Homo sapiens
  misc_feature 31: n = A,T,C or G
atgtgcctgaatttttatatctagaaacagntgttttagaattctggacttttgttgtcttagggatgattgattaggaagggactttaaccctggttttaataaccatttttaaagatacaaacacagaaaaaaaagggaaaaaattgtggcagagttcacac

SEQ ID NO: 29096 - DNA, 458 bp, Homo sapiens
  misc_feature 178: n = A,T,C or G
gaaaaaataggcatgggctacaggcctatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagncttcatcattttcatcattgttcctacgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgt

SEQ ID NO: 29097 - DNA, 425 bp, Homo sapiens
tagacctctgagtacatgctttggagctataggcaaagtcccagtactggggccaatttgccagttcagttgtcagcttttaaattctctggattcctacttgctaaggccaaatctcttcagtaaacagctcccttgctggaaagcagtcctttggctttgttataaataaattttgtcagcttgtggaaaatagaataaacctttgaaagtcaccactggctaatgaaagcttcttagatggctctagactggacgcggtacttaaaaagtacctataaaaggatatgtctcggtgggggttggagaagagtttgaaattaattatctgaactctgaaaattcctgtaaattctacatttagtttctgctataccttagaccatagatcttgtcctgattttaatgaggcatactttttagga

SEQ ID NO: 29098 - DNA, 299 bp, Homo sapiens
  misc_feature 6, 31, 293, 298: n = A,T,C or G
aactancaatatttaagtttgttgctgtcanttatttttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcanaccanc

SEQ ID NO: 29099 - DNA, 145 bp, Homo sapiens
  misc_feature 66: n = A,T,C or G
agactgtgcatggtggttcacacctgtaattctagcactttgggagggtttggggggccgaggcangaagatgacttgaggcgaggagtttgagatcagcctgggcaacataatgagactaccctccaaccccttacaagacatt

SEQ ID NO: 29100 - DNA, 340 bp, Homo sapiens
  misc_feature 32, 337: n = A,T,C or G
attcccaaacctgaaaaaaatcgaaatttganacactctggtcgccagcattttggatgagggataccaagtctgtatctgttgttattctgcttttttagaatgtgaagttatattttgtgggatatgccccagctaacattgccatatgatgtccgatagctgaggttgcgttcttaagtattagagaaacaaatctcattccttttcatcaagaccaaatgtgcttgtttgacaatatcatttcaggtagcaaccatctagatttgagaaatatcttgatatatctttaatggcatctagaacaatatgcaataaaacttagtctctgattatnaac

SEQ ID NO: 29101 - DNA, 384 bp, Homo sapiens
  misc_feature 6, 34: n = A,T,C or G
aaggtncccgagacgtcgctttgaacgtgctatnggaccttctcaaacacacaccatccgaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactga

SEQ ID NO: 29102 - DNA, 496 bp, Homo sapiens
cagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgagg

SEQ ID NO: 29103 - DNA, 237 bp, Homo sapiens
  misc_feature 7, 28: n = A,T,C or G
attctantttgacatgagcgtagaaccngcgtacgtcctaaaacaaaacaaattaatgttgttctaaaggctgttaaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgctt

SEQ ID NO: 29104 - DNA, 497 bp, Homo sapiens
gttatggtgtgaaaacagtttggaccctgggggttggactgttattcagaaaagaacagacggctctgtcaacttcttcagaaattgggaaaattataagaaagggtttggaaacattgacggagaatactggcttggactggaaaatatctatatgcttagcaatcaaggtaattacaagttattgattgaattagaagactggagtgataaaaaagtctatgcagaatacagcagctttcgtctggaacctgaaagtgaattctatagactgcgcctgggaacttaccagggaaatgcaggggattctatgatgtggcataatggtaaacaattcaccacactggacagagataaagatatgtatgcaggaaactgcgcccactttcataaaggaggctggtggtacaatgcctgtgcacattctaacctaaatggagtatggtacagaggaggccattacagaagcaagcaccaagatggaattttctgggccg

SEQ ID NO: 29105 - DNA, 457 bp, Homo sapiens
  misc_feature 7: n = A,T,C or G
gaggccntgaggcagccagcgcaggggcttttgctgagggggcaggcggagcttgaggaaaccgcagataagttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagaga

SEQ ID NO: 29106 - DNA, 204 bp, Homo sapiens
  misc_feature 31: n = A,T,C or G
ggggcagccaccatcaagaagcccctctcangggccagaactcctttgccagcgtggatttctcaagtcgggactgcataattaaagcagttgcagttttattttttttacagcttttttcccaaaaatgatttgtagttgtgtgtgcagcacttcgccctgatatgtgtgctctacaataaaaaccaaatctagtatattttg

SEQ ID NO: 29107 - DNA, 434 bp, Homo sapiens
aactcaaaacctactgagatcctttttataactgtcagattggcaaagatcaaaaagcttgttaagactcctagctggcaagcatgtgggaaataggtactctcataacagctgacagaagtacatattgaagaggacaatatggcaatgtccttcaaaattataaaagcactaactctttgatccagtagtttccacttctaggaacttaaccttcagatatattttcaccagatacaaaatgacatacgtaagaagttattactgcatcatttgtaatagctaaagattagaaacaattaattgctatggaacccttaaaaaaggtggctctaaattccttaagaaagatatccaaaacaaattaaggggaaaagggagggttgcataacagcatgtaacataacactatttgtctaaagaatggggaaaga

SEQ ID NO: 29108 - DNA, 137 bp, Homo sapiens
gaaggaggctaaggagaagcgccaggaacaaattgcgaagagacgcagactttcctctctgcgagcttctacttctaagtctgaatccagtcagaaataagattttttgagtaacaaataaataagatcagactccg

SEQ ID NO: 29109 - DNA, 193 bp, Homo sapiens
tgtctacttgaaaatagtaggaattggtataaagaaggtttcaaaatttttgtagaggtccatttactgtaggattttgttaataacttttgaattctgatacaaggacagcttttaatgttttgctgagagatttgtgtaggaatataagcttacctacctgttgctgagttgtaaacctgggaggattgtt

SEQ ID NO: 29110 - DNA, 185 bp, Homo sapiens
  misc_feature 5, 29: n = A,T,C or G
catgncattgggtactttctgcattgggnccaggcagccgggcctgccatttgaggcagcgagcctccgtgacctgtcctccctcatttgtaaagtggggtaacagctatgtcactggccagttgtggggattaaagtgctgagcttagtgcccagcccaaaatgctcaataaagctattcagtg

SEQ ID NO: 29111 - DNA, 265 bp, Homo sapiens
atgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatcagtgccattggtgtgtgtgtaccgtaactatatacatatgtgtgtgtgtgtatatatataatgtgtcataaccgtaaacaataaacaatatcaagact

SEQ ID NO: 29112 - DNA, 486 bp, Homo sapiens
  misc_feature 11, 29, 31: n = A,T,C or G
gaatccaaatntatgaagcatactctcantnccagtggaataaaaatgaaatcaataccaagaagatctcaaaagcacaccattacatggaaattaaataactgctcctgaatgacttttgggcagataatgaaattaaggcagaaataaaacaaattctttgaaattaatgaaaacagagatacaacataccaaaatctctaggatgcagcaaaagcagtttaagaggaaaaattgtagtgctaagtgcctacattaagaagttagaaagatctcaaattaataatctaacatcacacctagaggaactagagatacaagaacaaacaaaccccaaagctagcagaagaaatcactaaagccagagcagaatggaatggaattgagaccaaaaatccataaaaaagattaacaaaagcttgaaagcctgaaaccttgaaaggaaacgttggttccttgaaaggatgaacatgactgatgaacttc

SEQ ID NO: 29113 - DNA, 173 bp, Homo sapiens
  misc_feature 25, 31: n = A,T,C or G
catgcatggagctcaccctcccagnaactcnacacttaatgcccactgaggaaggagagaaatgcatgcaaatatatatcccaatgtagaaggaatattctagttcagtaacttccactcctgagcttttatcaaatttttctctatagaattatttttgttttattgtgtcc

SEQ ID NO: 29114 - DNA, 386 bp, Homo sapiens
  misc_feature 6: n = A,T,C or G
atggcntttatctggtaatgtgtttcagaaaagctagaatgaaaatgtgatgtaagggatagcaagtgtaggttgattcataattcttggtataaaaccaagttttccttagtcttgaggaatttgaagaaaggtaaaatgttggattttaagcaaagtaggattgaccagagactgttctgactttgacattcagacctttcagatgttcttccttcagaccagtccaagacactcagcatttccagccaagttgtcttttttttctgccaataaagtattcattagttgatgtttgtttgtattttaagtaaagtcaattttttttaaagcattaatttaattcacgggtatgcctttcatttctctggccttcagttggttga

SEQ ID NO: 29115 - DNA, 470 bp, Homo sapiens
aaaacccatttatgctaggatgctaatggcttacaagattagtagctactcctcccatcaggaattcatatttactggaaaatgctccaaatgaaaaaataacccaacaatggtacaattcttgacactgtgactgaggaacttattttaggttaggaaaccaattttgtatatttagattgtaccatataagctcttgcttacactgactatttgtaagattgtccttgtgtcaaaatagtcatcagtcattaattccaagtgatatggcaatttatgagataaaatgttgggaaacacccataaaaaactgataatgccacttagctctcaatgtcaagtgtctactcattcgtttgcatgctctgtagaaaacttagcctgtcacagagtctacacctgccattctccttctttaaagtagaagaaaaattccacaaaaagatatttgatatcctgtgagtgacaca

SEQ ID NO: 29116 - DNA, 439 bp, Homo sapiens
  misc_feature 30: n = A,T,C or G
gacaaccttagccaacctttacccaaatanagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagag

SEQ ID NO: 29117 - DNA, 486 bp, Homo sapiens
  misc_feature 30: n = A,T,C or G
ggctctggttcttataaaaacctcacagcnttccactaacatcccgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgta

SEQ ID NO: 29118 - DNA, 490 bp, Homo sapiens
  misc_feature 4, 27, 28: n = A,T,C or G
ggtncccgtccttgagacgccgtgccnnttcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccga

SEQ ID NO: 29119 - DNA, 481 bp, Homo sapiens
aggcatctgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaaga

SEQ ID NO: 29120 - DNA, 408 bp, Homo sapiens
  misc_feature 35: n = A,T,C or G
aatatccccaaggactaacccctataccttttgtntaatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccg

SEQ ID NO: 29121 - DNA, 372 bp, Homo sapiens
gagactgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccct

SEQ ID NO: 29122 - DNA, 353 bp, Homo sapiens
  misc_feature 4, 29: n = A,T,C or G
cttnactcatgtcttgccaggatggttanatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatg

SEQ ID NO: 29123 - DNA, 457 bp, Homo sapiens
gaacaccttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattacctat

SEQ ID NO: 29124 - DNA, 386 bp, Homo sapiens
  misc_feature 6, 24: n = A,T,C or G
atactnagatctgttgatctaatnggcagtcaaatgagacaggcaggatggtaaataaactgagaactttcatatctaaagagcaactgaaggaccctcatcttctcaaccctaggaaaacatttactttaaaacattggatgtatttttcctgttgatgttccaatttaaaagtcactgaaagattccttttaattgcttaattaaccagaaggcttctattaatcttaaatatctcaattggtattcctacaggatacttctatacatttgttgaatgagccagagtgtagatacacagcctttttttgcctatcctttgagccccaccaaatttaacaagaatacatataagtaaatacagaatttccttttaaaccacttat

SEQ ID NO: 29125 - DNA, 392 bp, Homo sapiens
  misc_feature 356: n = A,T,C or G
atggccgggtgggtcgaatttttatatttctgcaaaataaaaaattatattgggatttcaatagggaatgcatggaatctgtggatcccttttggtagtagtgacatcctaacagtattaaatcttctaatccctgcacacaggacttccttccatttatttgtgttgcctttaatttctttcagcactatcttctagttttcagtatgcagatctttagcctcctttgttaagttcattcctaagtactttattcctttggatgctataggaaatagagttgtttttcaaatttccttttctattttacttaatttgaattaatttagatttaaattcaaataggcaaatgtggntagtggctaaatttagaacatcttcatcatatcaga

SEQ ID NO: 29126 - DNA, 187 bp, Homo sapiens
ctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagc

SEQ ID NO: 29127 - DNA, 461 bp, Homo sapiens
  misc_feature 6, 31: n = A,T,C or G
gaagcnccccaggatttcctgtgagggcccntttaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcaga

SEQ ID NO: 29128 - DNA, 311 bp, Homo sapiens
  misc_feature 31, 308, 310: n = A,T,C or G
atggccgatgacagggaggtcttttccaatnggcactcagaacacaggtcaccgtatgttctcagccagtaacaatcatactgaggacgaaggactctccgtttgatgcagacacaattgtaatggagatgtaaaacttcttagcaatcagatggataaattctttgctttttactttaaataggaaattgttttctaaaactaaaatacttgaattgtcagacagtataatctcagcttgtattagtttttgaatgctcccatcgaggaagtgtaacaatccatgaaatgtgaataaatgaaaagtnanc

SEQ ID NO: 29129 - DNA, 453 bp, Homo sapiens
gattaccctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttttcctggtttttgtttggttttcgttttgcttttagcctctacatgctaggatcacaggaagactttgtaaggacagtttaagttctcctgcaaggtttaatttgttatcatgtaaatattccaaagcaggctgccttgtggttttggccggccttgtgctatgttgataagattgatttactgcttaaaatcactttactttatccaatttttactgaactttttat

SEQ ID NO: 29130 - DNA, 417 bp, Homo sapiens
  misc_feature 23, 32: n = A,T,C or G
atctcttagaacatttgaaagtnaggcaaatnctggaatgattcttttttgtgtgagactgtcaatttcattgcaggatgccttgtttctgtggctgttgtccagtaaatcccaatagcaaccccttcccaataattctgacaactcaaaatgcctctcttcaccccccaccaattttcagaacaacttttcctccactgaaagtcattcaggctagattcttgtctgatagggtagaaaatatcccagaaaagaaacaggtaaattctgaatatccatcctccctatgcagagttttaacaagtgtcagataactacagtcatctgtactagggtgatttaattttgatttttaaatttaattttttggaagaagatgctcacttatgctgttacttcataaaatgaatacacctg

SEQ ID NO: 29131 - DNA, 439 bp, Homo sapiens
  misc_feature 8, 9: n = A,T,C or G
aaggaatnngtgatagcctcacacttcagcttgttaattaaataacataaggaaaaatcctccaaatcgtagaaagaattggtgctaagagacaacactatgaaatagaatgaaatcaaattttttaaaagtctgcaatataatactttgttgataaaatacagtatagtggtggggcacagtggctcacacctgtaatcccagcactttgggaagccgaggtgagcggatcacctgagctcaggagtccgagaccagcctgggcaacatggtgaaaccccgtccctactaacaatacaaaaaattagccacgcatgatggctcatgcctgtagtaccagctactcaggaggctgaggcaggagaattgcttgaacctggagggcacaggttgcagtgagccgctgcactccagactggatgacagagagagactccat

SEQ ID NO: 29132 - DNA, 466 bp, Homo sapiens
  misc_feature 6: n = A,T,C or G
ctgcgncaacacgtgcaccctgagagacatgtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataac

SEQ ID NO: 29133 - DNA, 175 bp, Homo sapiens
  misc_feature 31, 145, 156: n = A,T,C or G
gcttccaaattttgtaaattgtttatttttnacttatctgtttgtaaattgtaactgattaagaattgtgatagttcagcttgaatgtctcttagagggtgggcttttgttgatgagggaggggaaactttttttttttctatanacttttttcanataacatcttctgagtcat

SEQ ID NO: 29134 - DNA, 371 bp, Homo sapiens
  misc_feature 7, 31, 33, 106, 229, 237, 371: n = A,T,C or G
atgcacngcaaaaacaggtacgaaccactgntntaacacgccaaaatataaagatcaaagatactataaaaaaaaaacccaccaactaatgtgcaaagaaaccatntagaataatgatgacatgatcaaattcacacataacaatactaaccttaaaggtaaatgagctaaatgccccaattaaaagacacagcctggcaaattggataaagagtcaagacacaatggngtgctgtnttcaggagacccatctcacatgcaaagatgcacataggctcaaaataaagggatggagaaaaatcttctaaggaaatgaaaagcaataaaaagcaggagttacaatcctagtcactgaaaaaaaggagtttaan

SEQ ID NO: 29135 - DNA, 317 bp, Homo sapiens
  misc_feature 5: n = A,T,C or G
ctggnctttccctgagttctcgtggctgttgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgctcacgattcaataaatattggatgaattt

SEQ ID NO: 29136 - DNA, 485 bp, Homo sapiens
  misc_feature 56: n = A,T,C or G
ggagaccggaggtggtggcggcggaggctttggcagctcgggactgagtgcaagantcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatg

SEQ ID NO: 29137 - DNA, 489 bp, Homo sapiens
gatgaccgcgacttcgagccctccctaggttccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctccta

SEQ ID NO: 29138 - DNA, 499 bp, Homo sapiens
  misc_feature 3: n = A,T,C or G
atnatttatggaaatagtgaaagccaggcttcatggttcagccagctctggtgggaaagtgcagggtgtgtgcaggaaacaggtggccagaagctgaaatcaaggccatctaaaatcatggttttgatctgaagacaaagagcacatgagaccctgagcaagtccctcttcctttagctccagaccttggcttcctcctctaaaataagactagccattttctctggggtattggtggtcactttaatttttttctcgcttttggtattattgatttttctttactacgatcatatgttactttatttaaagccaaataaaaatgaaggcaattttctgttttaaaaaaaaaataattctatggccctatgcagtatacctgagcccagatgggagaagacttaacttctctttgaatttagggaactaaaagaaagatttcatccctgatctggagggcagttaccaactactggaaatagagtggctccaaggctca

SEQ ID NO: 29139 - DNA, 470 bp, Homo sapiens
  misc_feature 6, 55, 96, 115, 124, 198: n = A,T,C or G
tattcntaatggattacttaattaggtctttgtggcgtatgatatagatacttgngttatccatggttcctggcttctagctcccataatccttgntataatgttggggcacttnaggcctcangaaacggaatctttccctctaaccttctcctgtcctcctttcacttgcccaaggcaggactctaatctgatcgncggtcaaaataccctcattccagatcctgtcctatgcaggcacatggatgaagctggaagccatcatcctcagcaaactaacacagaaacagaaaaccaagcaccgcatgttctcactcacaagtgggagttgaacactgagaacacatggacacagagaggggaacaatatacaccagtgaggggagggaacttagaggatgggtcaataggtgcagcaaaccaccatggcacatgtatacctgtgtaacaaacctgcacgttctgcatat

SEQ ID NO: 29140 - DNA, 125 bp, Homo sapiens
  misc_feature 24: n = A,T,C or G
cgatgaagaacgcagctagctgcnagaattaatgtgaattgcaggacacattgatcatcgacacttcgaacgcacttgcggccccgggttcctcccggggctacgcctgtctgagcgtcgcttag

SEQ ID NO: 29141 - DNA, 342 bp, Homo sapiens
  misc_feature 341: n = A,T,C or G
agacaggcaacctatagacagaaagctgtcactttccagtgtatgttgctaagatgttttgatgtagtatttacattatattttttattgaataattctaaaaaggtattcagtatttttatgtcatttattagatgtttaaaattttacagaaaatttttgacaaaaggtgatttttaattttttctgtttttatttacattatggttatggtctggttatgattcaggcatattcatattcataattttgtagtaatgaaaacatttcaaaatagtaccatgagggattgcagcactaacagagttagagaaacaatgtaaaacacgatcgtttataanc

SEQ ID NO: 29142 - DNA, 185 bp, Homo sapiens
cgctcccctgtcagagactcaagctttgagaaaggctagcaaagagcaaggaaagagagaaaacaacaaagtggcgaggccctcagagtgaaagcgtaaggttcagtcagcctgctgcagctttgcagacctcagctgggcatctccagactcccctgaaggaagagccttcctcacccaaaccc

SEQ ID NO: 29143 - DNA, 211 bp, Homo sapiens
  misc_feature 16, 56, 95, 120, 176, 196: n = A,T,C or G
cttcccactttagatnatatattccccacagaaaatacaaaacaacagtattggtntaagaagtcttctttaaacagcaggctttcctgcgccanttacactcttactgggatgaagttnaatccaactctgaatcacacagggaaaggcatgaaattagctggaccacagttgtngttcatgatgaagataaggngtcaggattataccg

SEQ ID NO: 29144 - DNA, 444 bp, Homo sapiens
  misc_feature 176: n = A,T,C or G
gctgcacacaaactggccgctgccgagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtntgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatga

SEQ ID NO: 29145 - DNA, 402 bp, Homo sapiens
  misc_feature 7, 30, 32, 57: n = A,T,C or G
cagggcntgcagtggtgtttaggcaggatntntctttactggccctgactgctgttnataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgtctggtgttgaggatcaagtgccatagcctttattcagggggcctataaacccttccagttcttgccccagggctggcctgctagcgcttcaaattcccaggtgtccctaatttgagaagtaaccttttggaatagcattagaccctggctgtcccctccccaccaaataaacatgatatttcatt

SEQ ID NO: 29146 - DNA, 211 bp, Homo sapiens
  misc_feature 15: n = A,T,C or G
gtataccatttattnatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttact

SEQ ID NO: 29147 - DNA, 122 bp, Homo sapiens
gtctgctgcgttcacggcaggattcggttaggaggaacagcacagcatgctgggctctggatttaaagctgagcgcttaagagtgaatttgagattagtcataaatcgccttaaactattgg

SEQ ID NO: 29148 - DNA, 481 bp, Homo sapiens
  misc_feature 26: n = A,T,C or G
atgatgaaatgatgagatgaaatgcntgagatgagatgtgatgaaatgatgatatgaaatgatgacataaaatgagatgaaatgagatgtaatgatggaatgagatgagatgaaatgagatgaaatgatagatgagataaaatgatgatatgaaatgatgagatgaatgatgagatgatgagatgaatgatgaaatgaaatgatgagatgagatgatgaaatgaaatggtgagatgaaatgatgagatgaaatgaaatagtgaaatgaaattgaaataaaatcgaaatgagagatgaaatgatgagatgatgaaattgatgaaatgatgagatgtgatgagatgaaatgatgagatgagatgagatgacatgaaataatgaaatgaaattgaaatgagataagatacgagctgagatgcaatgagatgaaatgatgagatgaaatgaaatagtgaaatgaaattgaaataaaatcgaaatg

SEQ ID NO: 29149 - DNA, 460 bp, Homo sapiens
  misc_feature 13, 54, 61, 83, 85, 88, 121, 159, 178, 226, 236, 238: n = A,T,C or G
tgaacttgtaggngttaggaatcctgttctctcgctcaatatgcgtaacaatgngagtatntctaagaatccataaacagagncntanatctgcccctggaaccagccttcctgggaaatnccaaaaacacttgcaaattcccatagggaatcttccanctaagtttagggcatattnagtccaaggtcaccgacagggtgaattatatgggtcaaatttctaggngtctgtatgngnctggcactccacttccattccaaactggctagaaaagaatgtttcatttttccattcactttcagtgtctgccctgttcccatagtaaccctttggctgtcaccctcccccaccttacacagatagatacacatcctttctgaattaaatggaactatatgacctaggttatttaagtcctccctatcctgtgtttgctcatctgtaatagggtgataatag

SEQ ID NO: 29150 - DNA, 281 bp, Homo sapiens
agagcactctgatggttttggcataatagctgcatttccagacctgacctttggccccaaccacaagtgctccaagccccaccagctgaccaaagaaagcccaagttctccttctgtccttcccacaacctccctgctcccaaaactatgaaattaatttgaccatattaacacagctgactcctccagtttacttaaggtagaaagaatgagtttacaacagatgaaaataagtgctttgggcgaactgtattccttttaacagatccaaactattttat

SEQ ID NO: 29151 - DNA, 460 bp, Homo sapiens
  misc_feature 3, 8, 32: n = A,T,C or G
atnctccnggtgtcttcattttgacactcttntgtcacatattgtcatttccaaacatggggctatgacaacacatgaaaacacatgagaggtctccttaatctcctgcctaaactgtcttcaagttccctctttaaatacgttattaatatgcatagtgtgcagagtcctagaaacttctgttacacagggtgacatcttccaactttgtctctggattctgcctagcatcttacatgcttacatcttacatcttacatcttacatcttgcattctgcctagcatcttacattagctcttacatgtctgtctgttgacttactgttgactgaaccagcagggcattggagagaagtaagagctagatgtagtggtggattctgtggtccaaattcatagatcacaaacttcatatgtaccagagtatgtctaggtactgggaagatgttctcaattctg

SEQ ID NO: 29152 - DNA, 408 bp, Homo sapiens
  misc_feature 405: n = A,T,C or G
gtctaagacggcagcaggcccagtgctaccacacagcctgggtctgtactgtggttacttagagcagctgggactcctgacacgtaagaggttgggagaggtggtagctcctttctcaaagcagctcaacagcagctggtcctggagcatgaggggtgtgcagccaagtttccctctcaggttccctggtgggaatggctgttggttacctcagtggcaagagatgccagtgtcctctactgagcagactgctgggaacatggtggctgctgccatgtggctgatactgatagcctcacctttctccattgctcctggtgtctcaggtatgtcaatcttatctgcaatcctttccatgtggaaattctcttttaaaaaaaaaattttttttcactgtgttgttgnaga

SEQ ID NO: 29153 - DNA, 488 bp, Homo sapiens
  misc_feature 24: n = A,T,C or G
catggagtccatcttccacgaganacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacaggtaacatttcttacccttccttgtctttttttcttatattgtaccccatttaaaactaaaatgtgggccaggtgtggtggctcatgccaacagtttggga

SEQ ID NO: 29154 - DNA, 500 bp, Homo sapiens
  misc_feature 21: n = A,T,C or G
tctagttatttcgtcctcttncgcccttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaac

SEQ ID NO: 29155 - DNA, 467 bp, Homo sapiens
  misc_feature 2: n = A,T,C or G
gntttccgcctcttttgtctttccgtggttttgtcgccatgaaggtcgagctgtgcagttttagcgggtacaagatctaccccggacgcgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggttcaacgagaacaagctatcagggctgctaaggaagcaaaaaagactaagcaagcatctaaaaagactgcaatggctgctgctaaggcacctacaaaggcagcacctaagcaaaagattgtg

SEQ ID NO: 29156 - DNA, 470 bp, Homo sapiens
  misc_feature 7, 56: n = A,T,C or G
attgtcngtgcttttaaaattcaaatcttattcctaaataaacagtatttcttgantgcttacaagtcattacagcttcaattttgcatctctgctgacttgaattctaaaatagctcatagtcagatctcctcttgagtgattttccataggaagaagaataggctgtgactatcaagcaatatggtggtttagatacacctgtaagtggaatagtcaattggaagtgacttaatgaacatttcaagtggccataagctctgtctttaaaaaaatacacatatacacatgtgtgtgtgtgtgtatgtgtatgtatccctgacacctcagtaggcagattctttctaactcttaatgtcttcattgtctttggtgaagggagaaggtctgagctaattttacttgtacaataagaaaaaacctaggatcagatcatagtaataatatgctctatccttgaataatttcac

SEQ ID NO: 29157 - DNA, 295 bp, Homo sapiens
gttccctctgaggttgtttaaaatcaatatttctggctgggcactgtggctcacacctgtaatcccagcactttgggaggctgatgcaggtgttcaagactagcctggtcaacatggtgaaaccccgtctctactgaaaatacaaaaattagccgggtgtggtagcgtacacctgtaatcccagctactcaggtagctggggcaggagaattacttgaacccgggaggcacaggttacagtgagccgagattgcaccacctgcactccagcctaggtgacagagtgagactccgt

SEQ ID NO: 29158 - DNA, 374 bp, Homo sapiens
  misc_feature 31, 34: n = A,T,C or G
aatatgacccttaattaatgaagtcctcccnttnccctccctgccaccaaaaaagagacaggtcagttcgggaagttggaatgtgaactggatattagataatgacaatacgtcaactttaactttgttgggtatgataatggtattgtggctctgaaggagaatgtccctgttcttaagtatttatgggtgaaataagatgtctcccacttattaatactttcaaaaatcacagcaagaaaacgtgtatgcatgtagctaaaacaaactgacaaaaatgcttatgataggtgaatcaaggtaaagagaatgggatgttcttgttctcattcaactttttgggtagctttaaaattttttgaaattaaaagttg

SEQ ID NO: 29159 - DNA, 400 bp, Homo sapiens
  misc_feature 6: n = A,T,C or G
gaaggncgtgaaaaaaaagtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatga

SEQ ID NO: 29160 - DNA, 160 bp, Homo sapiens
cagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcatttta

SEQ ID NO: 29161 - DNA, 125 bp, Homo sapiens
  misc_feature 5, 19, 29, 38, 42, 45, 49, 61, 77, 79, 88, 90, 100, 110: n = A,T,C or G
cggtngcaattgggggccncatacgcgcngacgagtantggncangctncttgactacacngacgcgccgtacaggntnaattatggnancttacatggnaaaggggcanctcaatgtcccacag

SEQ ID NO: 29162 - DNA, 209 bp, Homo sapiens
  misc_feature 8, 154: n = A,T,C or G
tctcgganggccatggggctcttttgtctgatggtagcctttctcatcctctttgccatgtgaaggagccgtctccacctcccatagttctcccgcgtctggttggccccgtgtgttccttttcctatacctccccaggcagcctggggaacgngggtggctcagggtttgacagagaaaagacaaataaatactgtattaataagatg

SEQ ID NO: 29163 - DNA, 468 bp, Homo sapiens
gtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgatt

SEQ ID NO: 29164 - DNA, 252 bp, Homo sapiens
aaagacttaaagtacatctaacctggacatttttatgtgtcactaggaattcttctcaagctggtttaagcagctcataaacttacatcgagtgaaaggtttactactttgctattctagaaatatatgaagttactgaattcatttaatgttcttcataggtttttaacaagttaatcaggcgctacaaatacctggagaaaggttttgaagatgaagtaaaaaaggtatgagtaataatgtactttgtgc

SEQ ID NO: 29165 - DNA, 499 bp, Homo sapiens
cggaaaaaacttacacggaaaaaccttacacagaaaaaacatacacttgtgtatgatggaatctgaagccactgaaaatcctacttgaaaagccatgtctaactcacctattgaatttttagttaacagcaactatttttcatacagtaaaatgttactaatttagattaagggagtgctgggggaagacactgatgccgaaactgaacaaatgttttaaaagaaatgcaggtttattatccagcactgagagagttaacaaggactggaaaaataaggctaacaaagaataggatgtgaatgttttcaagggccaaattaatgtatttataggtaaccagagcatatgttgcaaaaagacacattttaagaatcaaaatcaattctccaaaatgttttaaactttactgtatattctcgctagcaacagtaattctgtaaataccttttccccccataaacactgcaagggtaaacaataaatcttctttcctaatta

SEQ ID NO: 29166 - DNA, 343 bp, Homo sapiens
  misc_feature 2, 27: n = A,T,C or G
tncccggcggtgacgacctacgcacantagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacgggaggaaaagcaaggcttacagaaggatgttccttcaggaggaagcagcactaaaagcactctgagtcaagatgagtgggaaaccatctcaataaacacattttggat

SEQ ID NO: 29167 - DNA, 413 bp, Homo sapiens
  misc_feature 12, 25, 39, 41, 44, 45, 94, 98, 140, 165: n = A,T,C or G
tgttgtgcctgnttaactccagtanctcctaaagctcantngtnncggtctctggttttcatccttagagaagccatggagaacagacttgaanagtntaggaaatcataatgtggcagaggtggtgggaagaagaaagntgagctttttccccttgagaaactntctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttaga

SEQ ID NO: 29168 - DNA, 488 bp, Homo sapiens
gtatgcgcaacaacgtgatgaatatctggtttgtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctg

SEQ ID NO: 29169 - DNA, 114 bp, Homo sapiens
  misc_feature 23: n = A,T,C or G
gagtgcggtcacatacttccagnaagagcggaccagggctgctgccagcacctgccactcagagcgcctctgtcgctgggacccttcagaactctctttgctcacaagttacca

SEQ ID NO: 29170 - DNA, 246 bp, Homo sapiens
  misc_feature 12: n = A,T,C or G
aaggtggcaagnaagaagccctgaaacagcccaagtaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctatt

SEQ ID NO: 29171 - DNA, 104 bp, Homo sapiens
  misc_feature 23: n = A,T,C or G
ggggaatagggttcgattccggnaaggagcctgagaaacggctaccacatccaaggaaggcagcaggcgcgcaaattacccactcccgacccggggaggtagtg

SEQ ID NO: 29172 - DNA, 217 bp, Homo sapiens
atccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccac

SEQ ID NO: 29173 - DNA, 142 bp, Homo sapiens
  misc_feature 5, 73: n = A,T,C or G
gaggnaaacaacgtagaacctagaattagccgttaaaccaggaatctgaccaggttaaggacttgagttcggngtcactatcctgggatccaagtcatggcagagtacctggcttcgaagtacagtctttgcaggatgcagg

SEQ ID NO: 29174 - DNA, 500 bp, Homo sapiens
  misc_feature 7, 22, 33, 278: n = A,T,C or G
tcggccntttatggcccggganacaaggaagangaagagataatccatgaagcataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgnatttctcatgttaaagcctcttcccttgaaattaaaaaaaaattttaactgataaaacttagggcaacattaattaatgtatattcttacctgaattgttatacctttttgaaaatcctgtgacttgcctgtttctccccgctccaacgaaatcattaactctcctaaaatgtgtttcattctagtaagaaaacctcaaaggatattgtaggatataaatct

SEQ ID NO: 29175 - DNA, 471 bp, Homo sapiens
ctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgccgagagtgcccttctgatgaatgtggtgctggggtgtttatggcaagtcactttgacagacattattgtggcaaatgttgtctgacttactgttt

SEQ ID NO: 29176 - DNA, 120 bp, Homo sapiens
tctgcattcccaagaagtttatgtttattgtattttatatgatctacaacatataaaattgtgtatttttctttggttgtccctattaacaaaaaagtattttaataaaaaattgaaatg

SEQ ID NO: 29177 - DNA, 461 bp, Homo sapiens
ggtcgccatggggaagtcggattttcttactcccaagctatcgccaacaggatcaagtccaaggggctgcagaagctacgctggtattgccagatgtgccagaagcagtgccgggacgagaatggctttaagtgtcattgtatgtccgaatctcaccagagacaactattgctggcttcagaaaatcctcagcagtttatggattatttttcagaggaattccgaaatgactttctagaacttctcaggagacgctttggcactaaaagggtccacaacaacattgtctacaacgaatacatcagccaccgagagcacatccacatgaatgccactcagtgggaaactctgactgattttactaagtggctgggcaagagaaggcttgtgcaaagtggacgagacaccaaaaggctggtatattcagtacatagacagggacccagaaactatccgccggc

SEQ ID NO: 29178 - DNA, 377 bp, Homo sapiens
gtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccac

SEQ ID NO: 29179 - DNA, 356 bp, Homo sapiens
gaaaacagggttttaagaagaaatattggcaatcagggcatgcagaaggggtgtggaggtgtaggatctacatgacttgctggatgacttatctctagtcttgggtcattccttagcctgcccagcatcactggggacagagtcaggttgaggattaactgatgtattgagacaatctctctatggaggagaattctgggggatgcttattttcgttcaagatttggtaatttctaaacaaacatatacttagctaagctgacagtgcttgctggtggtttggctggtggaaaggaaggagggaaaagtttgaatttgcatttctaaggagctaggtaagacatgaacacacagga

SEQ ID NO: 29180 - DNA, 159 bp, Homo sapiens
ggagtctcagccctactccctcaagcactatagttgtagcaggaatcttcttactcatccgcttccaccccctagcagaaaatagcccactaatccaaactctaacactatgcttaggcgctatcaccactctgttcgcagcagtctgcgcccttacac

SEQ ID NO: 29181 - DNA, 243 bp, Homo sapiens
  misc_feature 25: n = A,T,C or G
tatggccgggatttggatgattgtnataaggtttttagcatgttcctccttttcttcaccctccccttttttcttctattaatcaagagaagcttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacat

SEQ ID NO: 29182 - DNA, 472 bp, Homo sapiens
acattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagcgttctgtttgaaactaatacttaccgagtcagactttgtgttcatttcatttcagggtcttggctgcctgtgggcttccccaggtggccttggaggtgggcaaagggaagtaacagacacacgatgttgtcaaggatggttttggggctagaggctcagtggtgggagagatccctgcagaacccaccaaccagaacgtggtttgcctgaggctgtaactgagagaaagattctggggctgtgttatgaaaatatagaca

SEQ ID NO: 29183 - DNA, 240 bp, Homo sapiens
  misc_feature 2, 12, 24, 99, 147: n = A,T,C or G
gnaaaaaaaaanaacccaactgtntgttgcctacaagaagaacacacctcatccattaaatataaacatagactgaaagtgaaggaatggacaaagatntcccatgcaaattcaaaccaaaaatgagcagaagcagccatacttgtnctagatacaatagactttaagtcaaaaactgtaaaaagagacaaagtcattatgtaataataaaataatcaattcaccaagaagcaaaactgt

SEQ ID NO: 29184 - DNA, 405 bp, Homo sapiens
  misc_feature 372, 383, 395: n = A,T,C or G
gacggaaaactggcggcttggtttgttcagcgcgtcgcggtcatggctctcgtttcaggcctccacggtgtgcacctggagtcaggagcgcgcttgtgcgtacagttcggttcagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcangaaaggcccanctgaaatcaaanaatctgctcg

SEQ ID NO: 29185 - DNA, 429 bp, Homo sapiens
  misc_feature 120: n = A,T,C or G
ggactaaaagtggttttaagttatgatgaggcctggggtatggccctaccccaatgtgtgactgaagtgggacatagaaggttctagaaatgagatggcttttagaaggtcatcactgcntttctagaagtgaagtgacagatgatagccctgtctggcgttgtgccatcaaaggagaggggaagggcacattggctttagtagatgaagctaaggggaaaagggtgtgtaggagaggaaaaaaatatcttcttcccatcttagtttcatagttgaggctcctgtaacaaaagacagattaacaagagaaaagcatacgaattgatttaatataaattttacattatatggaagccttcatcaggaagagaagacccaaagaaacggaagcctgtgtatttttatgcttaggtttgatgaagagtggac

SEQ ID NO: 29186 - DNA, 499 bp, Homo sapiens
  misc_feature 4: n = A,T,C or G
tgcntaacgcagcctggctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaagtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagatt

SEQ ID NO: 29187 - DNA, 143 bp, Homo sapiens
aactgagagcccatatctacaattttaaactttccagaccctgtctcaaaaagaaaaacaaaaattgtgtgtattttagctgaaattctcctggtagcagaaaatttacttcaggtagtaagaaaactttcttaaggctatac

SEQ ID NO: 29188 - DNA, 388 bp, Homo sapiens
  misc_feature 12: n = A,T,C or G
attggccgggantgtaaatgcaccttgtttgaattgttctagaactagagagttttgtcttaaggactcccaggctgctgccatgtgcgagataatctggaagaaggtctctttttagaatttatgaagagtacttctgagctgatgtgttcaagctatatcataagggtgtagactgtgctgacctctctcacttgatacctgttggcatgctgaggtcggctcttacttcctacctgagctctaaagataagaaagctaacacagttaataaggcttttgtgcccctcattagttgaatctggtattttcaaacataactgtttttcttgaggtctgcgcagcagatggcttattttaaaaattccattctttctgaatattttcc

SEQ ID NO: 29189 - DNA, 107 bp, Homo sapiens
  misc_feature 24: n = A,T,C or G
ggggaatcagggctcgattccggngaggagcctgagaaacggctaccacatccaaggaaggcagcaggcgcgcaaattacccactcccgacccggggaggtagtgac

SEQ ID NO: 29190 - DNA, 148 bp, Homo sapiens
atgacaccagagtctacaggaaggcgtggagctgccaaagcattatttttcatttgctgatggcttcgttcttgtgtacagtgtgaataaccttgaatcctttcaaagagtggagcttctgaagaaagaaatcgataagttcaaagac

SEQ ID NO: 29191 - DNA, 467 bp, Homo sapiens
  misc_feature 5: n = A,T,C or G
ggacnagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcggacctaacaaatattt

SEQ ID NO: 29192 - DNA, 217 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagt

SEQ ID NO: 29193 - DNA, 352 bp, Homo sapiens
cagaaatgtaaggagtgaagagcaatagaaataagaattcaatggttaaatataaataaatattgactttataaaataataattattatgttttgtggagtttaaaatatgtagggaataacatacatggtaaaagtagaacataaatccaaagaagttaatgaagttaaatcattctaagttccttgtagtgtacagggagtgataacgaagttgtgttgtcattgataagttaaggatgcatgttttaaagtttagataatctttaaaagaatgatgacagaatgtataaataacaagctaagaaagagggaaaatagaataataatacttaagaaattcaaacaaagac

SEQ ID NO: 29194 - DNA, 465 bp, Homo sapiens
aggctctgaaattgaggcaataattaatagtttaccaaccaaaaaaagtccaggaccagtatggattcacagctgaattctaccagaggtgcaaagaggagctggtaccattccttctgaaactattccaatcaatagaataagagggaatcctccctaactcattttatgaggccagcatcatcctgataccaaagcctggcagagacacaaccaaaaaggagaattttataccaatatccttgatgaacattgatgcaaaaatcctcaacaaaatactggcaaaccgaatccagcagcacatcaaaaagcttatccaccatgatcaagtgggcttcatgcctgggatgcaaggctggttcaacatatgcaaatcaataaacgtaatccagcatataaacagaactaacggcaaaaaccatatgattatctcagaggcagaaaaggtctttggcaaaattcaac

SEQ ID NO: 29195 - DNA, 306 bp, Homo sapiens
  misc_feature 302: n = A,T,C or G
aagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaanaaga

SEQ ID NO: 29196 - DNA, 472 bp, Homo sapiens
agggattgcaaaggacagtatcatgtgcccaactgagtgccatatacacctgtacccaccagcttgggatggccccaaactaagagttcactattaccccctttcttaatttcccagcacagagagaatcgagaatagcaggactcttggagagaatttagtccaaggcctatatattccatggcaaggaaaccccaaaggcctggattctagatcttactccagcacatactagctatttgacctttgtcagaccctgaaacccagagtttcctcatatatgcaatcaaaattgtcattttcttcactgagtaataaggatcaaaaggccgggcaccatggctcatgcctgtaatcccagcactttgggaggctgaagcaggcgaattacttgaggtcaggagtttgagaccagcctggccaacatggtgaaaccctgtctctactgaaaatacaaaaattagctgggcat

SEQ ID NO: 29197 - DNA, 131 bp, Homo sapiens
aagaaaaaagtaattaaaatggaacaacagtatgaatcttcatctgatggcactgaaaagttacctgagcgagaagaaatttgtcattttcctaagggcataaaacaaattaagaatggaacaactgatgg

SEQ ID NO: 29198 - DNA, 160 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgctg

SEQ ID NO: 29199 - DNA, 471 bp, Homo sapiens
ggggaagtctttcctttctcgttccccggccatcttagcggctgttgttggttgggggccgtcccgctcctaaggcaggaagatggtggccgcaaagaagacgaaaaagtcgctggagtcgatcaaccctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacct

SEQ ID NO: 29200 - DNA, 241 bp, Homo sapiens
ggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtagccaaatgcctcgtcatctaattagtgacgcgcatgaatggatgaacgagattcccactgtccctacctactatccagcg

SEQ ID NO: 29201 - DNA, 302 bp, Homo sapiens
gtcatttggtaatttctactgcattcttaccatccttctctcacaaattttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaagtgaatttattctgttatatttatgtaacttatttcctggaagttatatctactagttttgtttgataataataaaattagctatacccg

SEQ ID NO: 29202 - DNA, 462 bp, Homo sapiens
  misc_feature 27: n = A,T,C or G
atttcatatttacattatatgaaaatnaattacattataaaaggaatccctaatgcagaaacaaagatgcaactttcaaaattcttattattcctatttgtatatacacgagagaacccaaccagtgcctgtgtttggggggaaaagtcaacagtgtagttctaaaccttatcccaaacagaaaatgtggttaatgatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaat

SEQ ID NO: 29203 - DNA, 377 bp, Homo sapiens
cagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtacttggggtgcaactctttcttatgataggtcattagtgctttaagcaaaagatattagcagctttgactgcagcattagcaat

SEQ ID NO: 29204 - DNA, 417 bp, Homo sapiens
tagagatttgagtttaatttctgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaagggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttgggaagtactaaaagactattttataccttgttg

SEQ ID NO: 29205 - DNA, 269 bp, Homo sapiens
ggctcatgcctgtaatcccagcacttcgaaagacccaggtgggaggattccttgaggtcaggagtttgagaccagcctgggcaacatagcgagacaccatctctacaaaaagtaaaaaattagccatgtgtggtggtgtgcaacttgtgatcccagctacttgggaggctgaggtgagaggatcacttcagcccaggaaattgtggctgcaattagctatgagtgcaccactgcactccagcccaggtgagagattgagttgtccccat

SEQ ID NO: 29206 - DNA, 358 bp, Homo sapiens
ggataaagatatctactatttagtagatagtgccagttttttccaaagtgattgaaccaatttacattctttacaacagtgaatgagagttgccattttcccatattcttaccagtatttggcatggtcctttgtaatttttgtaatcctactttgtttgtggtggcatcacattgtggttttaattgcatttctctcatgagacctggaaggttgagcacctttcatatgtttattgggcatttggataccctttttaataaaacacctatatttttccatttttctattgggttgtatgttttttgttacagattttttttggagttttatatatattctagataaaagtcctttg

SEQ ID NO: 29207 - DNA, 227 bp, Homo sapiens
gaatgtggttcagggggacttttcttgggaacaaaatggatgatgatcagaggatctgccatcttttatttttcagaaacagaaaagtgaaatgacttggccaagtttatgcagctaagaagtaatattgctgggatttgaacccagagatttttgctccagcatgtgggtccttaaccacaaccctatacagcctctatgtggtatccttgaataaattaaatttg

SEQ ID NO: 29208 - DNA, 260 bp, Homo sapiens
  misc_feature 16: n = A,T,C or G
tgcccctttcgcaagnaggggacttgagaaactccacccatcaagctctttccatgtcctggtatactggtgtgggggccaaaactactctagtgatgcagatgcttgggggagattgtctcattggaaagatgtatgttggattgatgaagcacattgacttctatcaattcttttagcattgctaaaatcaaacccacactgtgatataacctatggaagtattagaacactaaagatgaatagaacatttttaatag

SEQ ID NO: 29209 - DNA, 277 bp, Homo sapiens
cacggtggctcacacctgtaatcccagcactttgggaggccgagacaggtggatcacgaagtcaggagatcgagaccatcctggctaacacggtgaaacaccgtctctactaaaaatacaaaaaaaactagccgggcgtggtggcgagcgcctgtagtcccagctactcgggaggctgaggcaggagaatggcgtgaacccgggaggcggaggttgcagtgagccgagatcttgccactgcactccagcctgagggacggagcaagactccgcccct

SEQ ID NO: 29210 - DNA, 241 bp, Homo sapiens
  misc_feature 235, 236: n = A,T,C or G
gtgagaagaatcaccttaatcaatttaggataaagctactgccttcaaaacagtatggtattggtgaaaggagagaaacacatcaaataatgttacagaatgaagagttcagaaatagactgacatatatggtcactttatttttgacaaaggtggtagattcaatggaaaaattgaaaggcaaaaggataaacttttcaacaaaagttctggaacaattttgcatctagatgcnnaaaac

SEQ ID NO: 29211 - DNA, 407 bp, Homo sapiens
  misc_feature 3: n = A,T,C or G
acnttcaaaggaacataggagagggcatgaaggggctaggctgaagcactctgatgactggggccaatttgtggctgaaaatgaatacactttttgaaatttatggtcattttcaagtgatttagaaggttgatccttagcctcatacagtgatgaaataatctgtgtgttcagagccaagcaggactttagcaagagtctgattgtattgtcactatctcggggaaaaaaaatacaaatacatttctctgatctctgatggcaatgaagtttgacttgtaatttctctggctgaggcttcttaattgctttctgggcagaatgtagattttggattcctgtccatgatgcctaatgttgatctcactttccttgtttctctcagttgctcattaatgtgtatttat

SEQ ID NO: 29212 - DNA, 131 bp, Homo sapiens
  misc_feature 4, 39, 49, 88, 98, 101, 104, 114: n = A,T,C or G
gacntcaacctaggccataaagcaagtgatgcctttgtnaatgtctttnttaatcaatgtatcagggtgaacgtgatgatatataaantatgtgaatntgnctnatcataacangaagcgcatactcagac

SEQ ID NO: 29213 - DNA, 464 bp, Homo sapiens
gacttgcaactgcggctttccttctcccacaatccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgagggatgaagattcaccaaataagctatatactttggttacctatgtacctgttaccactttcaaaaatctacagacagtcaatgtggatgagaactaatcgctgatcgtcaga

SEQ ID NO: 29214 - DNA, 367 bp, Homo sapiens
cacatgaaccgctccaccaatcttagccgttagtgtcatcaatgagaggaggctggatccaaattgaaaggccaggagcatcatgcagagtctgggcttcagcctataggcagtgagagccctggaagattttgccaagtgaatgctcaggtgggatcttgtttaagaaactcggcctcctaaagtgctgggatcacaggcgtgagccaccgcgcctggcccaccatggttttgtctatgtataaatggaattagacagcagggaaacttttgagtctggctttcttcgcttagtgtaatgctttagaaattcatcaagttctgtgaatgagttgctctttcttttcgttgctgtgtagtattccat

SEQ ID NO: 29215 - DNA, 471 bp, Homo sapiens
aactgtttatcgttttaaataatatcaaggaaggtaaacttctagttgacttgctttggattacagaagaagtcattttgtgttcataacagacaaaatattagtgcatataaaaatatgaaaacttttttactccaaataatacagcatgtaaatattatacatatatatcacataacatatatataaaaggaaaatggataatataattcatgtgtgaataaaaatgtctaaaatcaaatcaacaattattgtattcatcaaaattgcaaaagaataagccacaagtcaagaagatttaaacaaaactatatgtatagtttgatattagaatatgtaatatactattttaaaatgttaaaggaaaaatgtatcatttatgtaaaccaaaggagttcaattacagggtaatctcagttgtactataaaggcacttaatagctaaaccaccttaataataaaacgtcttat

SEQ ID NO: 29216 - DNA, 102 bp, Homo sapiens
gactgagagataatgaatgacacctgaaatgcatatggtatttttgggagagttaaggtataatttgaaggttggcagaccagttgcgctgattactcttag

SEQ ID NO: 29217 - DNA, 436 bp, Homo sapiens
  misc_feature 27: n = A,T,C or G
acatcaggattcctattccccttagtnatccctagaatattccactctgctcatttatgtattgccttagagtgaaaaatccattaaagtaatcttatgttctggtttgaactgatgccactgaaaatgctaaatattcttgccttactcaactttaacgcttgctagcatttaagattcttgataataaaagtataaaacattctacctaattaatttctaaattactaccttagtacaactattttctgataaaaatgatcaggtaccagactttgaattttgaatacaagattgctcttatatttaaccttatttgtaatataatggctaatgtaaagtctctagtctatatggaatagataaactcagggagttacagcaatgtaattttacagaagatttctgttcctcagagaagggagacagaatgttg

SEQ ID NO: 29218 - DNA, 480 bp, Homo sapiens
  misc_feature 64, 95, 99, 104: n = A,T,C or G
ctcttatggccggggagtgtgaaatcttcgacaagaatttctctttagttctttgcaagaaggnagagataaagacactttttcaaaaatggcantggnatcangaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttg

SEQ ID NO: 29219 - DNA, 462 bp, Homo sapiens
gggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgaaaggaggtggtcttaaataaattaaac

SEQ ID NO: 29220 - DNA, 111 bp, Homo sapiens
ctcaggaaggctgaggcaggagaatcacttgaacccgggaggcggaggttgcagtgagtcgagatcataccactgcactacagcctgggcgacagagcaagattccatctc

SEQ ID NO: 29221 - DNA, 470 bp, Homo sapiens
atgtatgttcctacttcacaaacaaagtttgaaggagttgctggtgtctgaagaccctcatcagaagctagcaatgttatcatcatttgctgcacatttgacggtgtaccagcctttcccctacttccttttaacatctgtattttctctgctgccttggaggcaagggatcggactccggcactttgcctgcttagttaaattaattgtttaaaaataagtgaaggctgagtgctgtggctcacacctgtaatcggaacactctgggaggtgaggtgggaggatcacttgagctcaggagttcaaggccagcctgggaaacatagtgagaagaccccatctctacaaaaataaataaataaataaaattagctaggcttggtggctcatgcctgtagtcccagctacttgggagcaaaggcgggaggattgcttgagcccaggagactgagtctgcagtgagctatgat

SEQ ID NO: 29222 - DNA, 224 bp, Homo sapiens
  misc_feature 16, 224: n = A,T,C or G
cagggatggtcagaantaaggggctgtttcagaagcgttagtggttagttttctgagaggaataataactaataattcaagttacttctaaattacacaaacttcactcatgatcaccacttttatggtctttattataaatagaatccctcagagagattaataatatttatatttactcctgtttaacaagtgcagcattaacgggccaataccatctagtn

SEQ ID NO: 29223 - DNA, 242 bp, Homo sapiens
  misc_feature 13, 26, 36, 41, 45, 48, 86, 100, 105, 129, 134, 143: n = A,T,C or G
gtaatagtaactnctcatttaaagtntatgaggaanaacgnttgnaantcacctagccggctggatacaaactatttcaggaaatnagaaaagagagggnacttnctagctttttacaatgttaacatnaccgngataccaanacataacaaggtcattgtaagaaaggaaatttatactccaatctctctcataaacatcaaattaaacatatcaaatattagcaaaataaatctagtgat

SEQ ID NO: 29224 - DNA, 129 bp, Homo sapiens
  misc_feature 7, 100: n = A,T,C or G
ggaggcntgtgcctgtagtaccagctactttgggaaggtgaggcaggagaatccctttactcaggaggcagaggttgcagtgagccaagatggtgccacntgcactccagcctgggcgacagagctctg

SEQ ID NO: 29225 - DNA, 367 bp, Homo sapiens
  misc_feature 2, 89: n = A,T,C or G
gnttggctgcagtatagcacattagttgatatgggtaagtacatctcccagtgtgggtctgatagtgtttggtttctagagaagtccanacttagtttacttattcctcttctttattattatttccatcattaaaaatatgatccttatcttagtttctgctgctgtgcagcactgggtggcttaaacgacagatatttattttctaccattttggaggcaggaagtccaagatcaaggtgccagaagatctggtgtctagtggcagcctgcttcctggttcataggcagcaatttacctgctgtgtcctcaagtggcagagagtagagagcgagagagagagcaagctctcaagtctctttttat

SEQ ID NO: 29226 - DNA, 226 bp, Homo sapiens; identical to SEQ ID NO: 14144

SEQ ID NO: 29227 - DNA, 179 bp, Homo sapiens
caggtgattctgatgcatgcttaagtttgaaaactgctgtttaaattcaacatatttcattgtagattaggaaattaaaagccagatataagtgacttaacctaggccataaagcaagtaaatgcttgtaaatgtatttattaatcaatgttcagggtgaactgttgatatataaaatt

SEQ ID NO: 29228 - DNA, 352 bp, Homo sapiens
atcaataaagccttttcgattggtgtttggcagctaattataagtggtagaatactagtgacactatgaaattatcattagcaagtaatagctaactgatatattctaagtcttccaattcattcatattcatattattcctctggaaaaaaagagataaatattccattatatattacttttttgtaacaaggcatatttaatatattttaaaaattcattttaggtgccaaatctgattccagttttgatgttcaaattgggaagaccactggaacctatattatataatgatatattgtatactttacctaagcttggtgttcacaaggttagtatgttaattaattta

SEQ ID NO: 29229 - DNA, 227 bp, Homo sapiens
cagaccccttcgttgtacagcaggtttgcctcacatgccagagtcggggtggcctcagggcacagccaggagatgtccccaaatcccgaaatgtggtttgagtcccagtccctcatctctccagcctccaagccctcacctatgcaatggtgccttgcccggctcacaggttatgaaaaggggtgggacgagacagtgtcccctaaatacatctgacagcacttttg

SEQ ID NO: 29230 - DNA, 400 bp, Homo sapiens
actgtaagccaggctgttatgcagagcctgttgcctttcctcgccgcggtttcacgtgggttttctctctcctttctgtctgacaggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagtt

SEQ ID NO: 29231 - DNA, 108 bp, Homo sapiens
gatttaaaaaaataataacctgttttctgactagtttaaagatggatttgaaaatggttttgaatgcaattaggttatgctatttggacaataaactcaccttgacct

SEQ ID NO: 29232 - DNA, 181 bp, Homo sapiens
ctgtctttttcctgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgttc

SEQ ID NO: 29233 - DNA, 265 bp, Homo sapiens
gtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctg

SEQ ID NO: 29234 - DNA, 461 bp, Homo sapiens
gaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccg

SEQ ID NO: 29235 - DNA, 466 bp, Homo sapiens
agtctactggatttctttactactgatcctttcgctgtgttaaaaatcaagtcacagagacctctcttctggatttgtcccatggggaccctgagactactaaagctgctttcttctgaaggtccagttggacagtctgggaatgtccagaaataaccagtgagaggggcagttctctggccacacccacttatgtactttaactactgtgactttgtctgcagaagagctggaaaattctcgaagctgcaccgtgtcctctgtgtgctagaataagggacaaatgggttccctgtgcttctcagctcactgtttttccttgagttctcctacaggaagcagatgagaactgcccagtcttcaggtttaggccattggtctttgatgtcatagattccaggcctgggaggtgttatgtctcttcagctgggaaaactagctcttcagagaagcctcgggtaacact

SEQ ID NO: 29236 - DNA, 339 bp, Homo sapiens
  misc_feature 10: n = A,T,C or G
agggaaaagnaagaattgtttaataaacagtgttgggatagccagttagtcatctggaaaaataatgttggcttccagaggagttaaagatttaaatatgaaacaaagaaacaaaaaaggtagggtaattattttttacgtaatccaggattggtgaagtcctttaatagcatactgggttgctggattttaggacataaaaataaaattctgtacaggggaaaaaatcaaacaaagttaaaagagaaacagactagtaaaacttatttgtatacttcacaaagggctaagttcctcttaatacaaagaactagaaaataatccagtagaaaaattagc

SEQ ID NO: 29237 - DNA, 463 bp, Homo sapiens
cacagtgtgaggtatgggggcgaacacaatttaggtcataacaggttccatcagaacatgaaaggatagtaaataaacatatattaagcattgaatccttagaagcacttacatctaacgattaataaaggggtggaaatccacgacaaaaacagaaacatggtcagagaggtatacagagagcaagaacggtgagattcaagaaagtgaaattcttttttgatatggaatgcatgatcaagttccttcctaataatatctaataatagtagtgaagaaaaaattatttttgtttggaacctagaaattattaaggatcttaacgaaatcagattctgttgagtggtgctgaaagttagattttgctgagttgatagctaaattgaaggcaaaaagaataaacacaaccaatttaccaagccacgaaaataatagattttgaaacttgtaagatctcacctta

SEQ ID NO: 29238 - DNA, 445 bp, Homo sapiens
tcttcttaattgggatcatcaaatttcttttcaagtctcatctatatatggcagcatctatattcacagtgttctgaaagagaggagtttgacccagatacagctgtagtgctcccatgtttgtggttaaagtaagctcacatttacagtcctaaaagacaacgtaatatatcaccagcatttgctgaatagttagtagagtaataaaggtcacagtcattgaagttagacaggcaagaaattaagctgtctcatatactagctgtgggatcttgggcaattgcgttacttaactgctctaggcttcactttccccaccttacaacacctgtcttagattattgtttatatatttaataatttgtaccatgacatgcagagatatttctattttgttgcccctccttgaaagaactaagaacaattctatttcagagtttactat

SEQ ID NO: 29239 - DNA, 347 bp, Homo sapiens
  misc_feature 18, 35, 43, 48, 52, 56, 57, 67, 75, 118, 235, 341: n = A,T,C or G
atggcaaaactggaatantctacaatgttacccancatgctgntggcnttgntgtnnacaaacaagntaggggcnagattcttgccaagagaattaatgtgcgtattgagcacattangcactctaagagccgagatagcttcctgaaacgtgtgaaggaaaatgatcagaaaaagaaagaagccgaagagaaaggtacctgggttcaactaaagcgccagcctgctccacccanagaagcacactttgtgagaaccaatgggaaggagcctgagctgctggaacctattccctatgaattcatggcataataggtgttaaaaaaaaaaataaaggccctntgggct

SEQ ID NO: 29240 - DNA, 396 bp, Homo sapiens
ggcccttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggcttttgtgttcaccaaggaggacctcactgagatcagggacatgttgctggccaat

SEQ ID NO: 29241 - DNA, 320 bp, Homo sapiens
  misc_feature 11: n = A,T,C or G
aaaccttaagnctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagt

SEQ ID NO: 29242 - DNA, 340 bp, Homo sapiens
taagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcata

SEQ ID NO: 29243 - DNA, 350 bp, Homo sapiens
agggaagcctgatatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactg

SEQ ID NO: 29244 - DNA, 308 bp, Homo sapiens
aagagtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattct

SEQ ID NO: 29245 - DNA, 248 bp, Homo sapiens
gatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttccttt

SEQ ID NO: 29246 - DNA, 250 bp, Homo sapiens
acggttactgtggtgtatggaatctgagggagaggtgatcaagtgaggggttttggcctgtgccgcagactcagctgggatgagcccccaggcccctgtcctctcatctctgccctcctcagagtagcagctctgtcctctgccttcggatgtacactgaggattgagcagcccaggcaactcctgagttttccattttaagcttcagccaccagagagactcactgacacgctcttggtctcctaaatg

SEQ ID NO: 29247 - DNA, 436 bp, Homo sapiens
aagaacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatataga

SEQ ID NO: 29248 - DNA, 477 bp, Homo sapiens
  misc_feature 10: n = A,T,C or G
aaacacaggncatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactactaaacctgcattaaaaatttcggttggggcgacctcggagcagaacccaacctccgagcagtacatgctaagacttcaccagtcaaagcgaactactatactcaattgatccaat

SEQ ID NO: 29249 - DNA, 118 bp, Homo sapiens
gagaaagtggtggtgagaaccttagagcagtggagatttgctacctggtctgtgttttgagaagtgccccttaggaagttaaaagaatgtagaaaagatactcagtcttaatcctatg

SEQ ID NO: 29250 - DNA, 481 bp, Homo sapiens
gtttcaaataaatgaactcaatctaaattaaaaaagaaagaaatttgaaaaaactttctctttgcctttcttcttcttcttttttaactgaaagctgaatccttccattttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttggttttgttca

SEQ ID NO: 29251 - DNA, 427 bp, Homo sapiens
aagcacttctggtacttcagtcgtttttactgatccaccaacacctaaagaggctattgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacgttccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcaga

SEQ ID NO: 29252 - DNA, 500 bp, Homo sapiens
  misc_feature 8, 13, 50, 58: n = A,T,C or G
tcaggtcngctcntgtgtgagacctttctgatgtttttgagaaccagtcnttttcttnttctgctcatctccttgtagagcttatttacaatctgccttgcataatactaattatgttaatcttcctcattagattgagcctccttgaaaatggacttttcttcccccacatttaggtcagtccttatagaaaacaatttttcaacaaatgtttgtctaatttatgctgaataattgaaatagtaaacattttgtggaattaattttgttgatatttttatttaagaaagacatccaaggaggcagattatataaaatgtttttgaaacacaatgaattggaataattttagaaaactagactattctgaattaaatattaaatacagtttatcacagtgatagtttaagttgataacttgaaatattcatttgtcaagtaaatgttcttcaggactcgaattaataaacagattaaaaatgtgattagcatgccaattg

SEQ ID NO: 29253 - DNA, 410 bp, Homo sapiens
  misc_feature 2: n = A,T,C or G
gnatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatct

SEQ ID NO: 29254 - DNA, 222 bp, Homo sapiens
  misc_feature 1: n = A,T,C or G
ncgaaacatacactaaaaaataatacatcatatcttaatttccactgaacttgatttaaattcagagttacacagtatgaatatcacaatcagatatgttcaaaaaggtctgaacaattgattttctgaaaccatgaaggactacaaatgcttctaataaatcaatgtaattaaaatgtcttttagaaataaacttatttggaaaaaaaaaaaaaaggggga

SEQ ID NO: 29255 - DNA, 252 bp, Homo sapiens
  misc_feature 12: n = A,T,C or G
tatggccggganacgggaccctgtttacatatagtaaatgtgtatgtatacatgagttgttgctgaagccgacaagcatattacatacatgcattttctctgtgccatcatagttgcagttacagttctagtaccagtaggctcacctgggaggcaggttagacccaaaggtagacatttttccctttcctgaagcatgatggtgggagttgattctttgatttccttagtaccaaactttaaggcttttac

SEQ ID NO: 29256 - DNA, 318 bp, Homo sapiens
atattgatttaatctaaaatatttgtttaattaaatactataaatgtttggcacttacatatttctgaaaatactttttctgattttggaagacctgttaaatggcaatttgttttcctcatattttaagtgcacagtgtttaactgtgccttattagacatgctttaaaccacatccaaacagataattctaacattcccagcaaacctctttaattgctgaataaatattttgaaatataatttaaaaagtgaagttctgtgtactatacttatttcttctaattgtagcaatactgtttttttttctaattttgt

SEQ ID NO: 29257 - DNA, 453 bp, Homo sapiens
  misc_feature 9, 13, 319: n = A,T,C or G
gactgaacngtcnggtggtgaattttccagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttangaagcagtccctggagaaggcatgttcccagaaaggtctctggagggacaaactcactcagtaaaacataatgtatcatcatgaagaaaactgattctctatgacatgaaatgaaaattttaatgcattgttat

SEQ ID NO: 29258 - DNA, 128 bp, Homo sapiens
  misc_feature 95: n = A,T,C or G
tatggccgggccaggcaccaaatgtagatttaaaaatgaaaaaccctaacaattgcagacttgaataattgggggggggggatttatcaataacncatgtgaaaaagatacaggggttttaattgact

SEQ ID NO: 29259 - DNA, 427 bp, Homo sapiens
ggagacgaacgcttcactggggcagtctctgcatatcatggggagatagacgctgctgcctttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaaggagaaagtggatcctaatgagcagttggatgaagatgtggaggagatgctgctgcagattgctgatgattttatcgaga

SEQ ID NO: 29260 - DNA, 465 bp, Homo sapiens
gatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatc

SEQ ID NO: 29261 - DNA, 473 bp, Homo sapiens
  misc_feature 7, 18: n = A,T,C or G
agaagangaaatccaggnaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgc

SEQ ID NO: 29262 - DNA, 438 bp, Homo sapiens
attgttggaaacccttccggccctgtgcgcctttctcatcagcttcttccgagggtgacaggtgaaagacccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctggtagaaagttttgctttgttgatctgagccttctatgaaagtttaaatatgtaacgcattcatgaatttccagtgttcagtaaatagcagctatgtgtgtgcaaaataaaagaatga

SEQ ID NO: 29263 - DNA, 473 bp, Homo sapiens
gaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatga

SEQ ID NO: 29264 - DNA, 404 bp, Homo sapiens
ggaggtgaggaaaactataactgacataaaacatccacctttctagtcagctgaggcttacagggaagcaaagggatacgggtgaagatgcaatgaccggggacacagacaaatatcttgggccacaggaccttaaggaattgggtgatgattccctgcctgcagagggttacatgggctttagtctcggagcgcgttctgccagtcatgctgccagcacagtagcaaaagagctcattgacaaaactgggagaaccaatctgagtcacatatttcaaaattaagttttgttccatattgaaagaaagtattatttgctaataagtgagaaatatgtgtttaggattgttcactattctctgttactgaaataataattcatgattaaaagagagcatttttac

SEQ ID NO: 29265 - DNA, 212 bp, Homo sapiens
  misc_feature 4, 16, 32, 33, 36, 212: n = A,T,C or G
aganccctttctgccnccttagcaccttgtannaantcagacctggaaatggggatgagggtgtaaattgtatttgaaaaagatcgcgaataaaaatcaacgaatgtgaaagcccagaaaaatatattcgtatttctggttttgctggatttttacatttttatataataaaaatgttattttgaaataaagattatgctgactcaaatgcn

SEQ ID NO: 29266 - DNA, 318 bp, Homo sapiens
  misc_feature 25: n = A,T,C or G
ggatctggccatctacgagccaaanactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcagc

SEQ ID NO: 29267 - DNA, 419 bp, Homo sapiens
aggacgaaacctgaagagcctgatccttcttgcctcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatattt

SEQ ID NO: 29268 - DNA, 447 bp, Homo sapiens
atagcactttgcatataataattgttaaatgactgtcttttgaatgagtgcataatgctacttgcctatctagaatatgtgtgaacctaattgaaagaaggctgaggctcttgaataagaaaggaaattgaaatgttatgtgatttaggtcagttttaaatgcagaccagactggtatagtgattattaatttgttaacctgctgtctgttctttaccatgtattaatatggcattagtccagatagttttaagtggccagatatctatctcctgtctcaactggctccaaggatttttggcactcaacaaagaggcgaagaacagaagggggttggaatgtgtgcctccttcttaccctcacttgtatgttttcaaggcaaaatatattacattcgtaatcaatcttgtataactagtgctatttaaaataactgtcattatctat

SEQ ID NO: 29269 - DNA, 159 bp, Homo sapiens
  misc_feature 13: n = A,T,C or G
gtacaaacttagnaagaaaattggaagatagaaacaagatagaaaatgaaaatattgtcaagagtttcagatagaaaatgaaaaacaagctaagacaagtattggagaaatatagaagatagaaaaatataaagccaaaaattggataaaatagcaccg

SEQ ID NO: 29270 - DNA, 333 bp, Homo sapiens
  misc_feature 331: n = A,T,C or G
aaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcngc

SEQ ID NO: 29271 - DNA, 447 bp, Homo sapiens
  misc_feature 20: n = A,T,C or G
ggcacatgggtggacacggnatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctggg

SEQ ID NO: 29272 - DNA, 235 bp, Homo sapiens
  misc_feature 10: n = A,T,C or G
attacaaagncgtgacaaatgatgccctgtgtgacttggagttatctttgacttttaccacaaatcttcatttataaaagaaaaggccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgc

SEQ ID NO: 29273 - DNA, 463 bp, Homo sapiens
  misc_feature 140: n = A,T,C or G
gggagggatctaggttgtgtgctccttatgagaatttaatgcttaatgatctgtaactgtctcccatcacccccagatgggatcatccagttgcaggaaaacaagggctctcactgattctacttatgattttgtatcangattgtaccatctcataaattgatgttggaattccatacattacttagaaaatcagaaaaagaagaacaccgtaaactggggttggaggtattatttggagtcttagattttgccggatgcactaagaatataactgcttggaaatacttggcaaaatatctgaaaaatatcttaatgggaaaccaccttgcgtgggttcaagaagagtggaactccaggaaaaactggtggccagggtttcatttcagctacttttgggcaaaaagtgattggaaggaagatacagctttggcctgtgagaaagcttttgtggctggtttac

SEQ ID NO: 29274 - DNA, 169 bp, Homo sapiens
gtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaatc

SEQ ID NO: 29275 - DNA, 162 bp, Homo sapiens
  misc_feature 161, 162: n = A,T,C or G
ataatatttttatttctttatcttccttcactttaaaataaggcctggtgtggtggctcacacctgtaatcccagcactttgggaggctgaggtgggtgggttgcttgagctcaggagttcaagaccagcctgggcaacatagtgggaccctgtctctgcnn

SEQ ID NO: 29276 - DNA, 342 bp, Homo sapiens
  misc_feature 341: n = A,T,C or G
gagacctaattcaacgtaagtaaccacctcctaaacacttagaaaagtcttgttttgcacaaatctcatcctcacctgtattttggagcaatgcttcatcttgtcctcctgaggtatggtattggtgactactactgcctcaaagcatgcgttgttgatgcgagaaatagcaggaccggagaagattccatgagtcaagatggcataaactctggtggcgccagctgagagaagtctagagggaaaaaatgttgatttggattcatcttacttgtcattgcagaattttagtcagggaggagtatattagcctgcttaggcttccacaacaaaatatcatnc

SEQ ID NO: 29277 - DNA, 344 bp, Homo sapiens
  misc_feature 15, 21, 26, 29, 131: n = A,T,C or G
gggtaggaagggagntgactncggcngtngaaggaacaaggcagaatgcaggcccttcgggtgtcccaaggcgctgatccgctccttcagctccaccgcccggaaccgctttcagaaaccgagtgcgcganaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcct

SEQ ID NO: 29278 - DNA, 133 bp, Homo sapiens
attgtttataacagaaagaaagataaatgcttgaagtgatggataccccgtctaccctgatgtgattgttatgcattgtatgtctgtatcaaaatatcttgtgtaccccatagatatttactatctactattt

SEQ ID NO: 29279 - DNA, 470 bp, Homo sapiens
gagtcctcgaagctcggaagcccgtcaccatgtcgtgcgagtcgtctatggttctcgggtactgggatattcgtgggctggcgcacgccatccgcctgctcctggagttcacgaatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctgggg

SEQ ID NO: 29280 - DNA, 423 bp, Homo sapiens
  misc_feature 352, 360: n = A,T,C or G
aatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacacttttggtaccagataactttttttttttntttataanaaagcctgagtactccacactgcacaataactcctcccagggttttaactttgttttattttc

SEQ ID NO: 29281 - DNA, 464 bp, Homo sapiens
  misc_feature 1: n = A,T,C or G
nggatgagaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggacttggaagacaatgttgtctgcagccagcctgctcgaaactttagtcggcctgatggcttagaggactctgaggatagcaaagaagatgaagaatgtgcctactgctcctgatcctccaagtcaacatttacgtgggcatgggacaggcttttgctttgattccagctttgatgttcacaagaagtgtcccctctgtgagttaatgtttcctcctaactatga

SEQ ID NO: 29282 - DNA, 367 bp, Homo sapiens
agtcatcaaactgttacatgcccactgaaaatggaaaagaatggactcttgtattacagcttaagtaatggatgccttctttttgtttcctattctgtgttcagtgctttaattgttcttgaaatgttttccacttgtctattttaattcttgtgagtactagaatagctttggccttttaaaacatttgtttattttttttctgagaatggctaacacactttattgaggttcgaaattaataaagaaaataaaagaaatgtatcttcattcattctgtatgttagtgttttaattacccttagaatatatggataaaaaatactattctttgtcttggagaaggtaagagtctagttagatgaat

SEQ ID NO: 29283 - DNA, 335 bp, Homo sapiens
gcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgaga

SEQ ID NO: 29284 - DNA, 189 bp, Homo sapiens
gggacaagtggtctgttgggagaatttatctatttggtatcttcactgggaactggaagtgggtgaatagaaataaaagggttttgagatgagtgcttgagatacgacaaaggaagttttcacaggctttggtgtgaaaaaccactttgctattttgagcctttgtgactcaaagaagatggtacactg

SEQ ID NO: 29285 - DNA, 465 bp, Homo sapiens
  misc_feature 441: n = A,T,C or G
gggatttccgctgagtgacccttacaagtccttcttgatcctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatgggttttnggatgtaccatttgtttcttattt

SEQ ID NO: 29286 - DNA, 128 bp, Homo sapiens
aatgaaatgcagtataaaggttggtgaagtgtaatataattgtgtaaacaaatcctgttaatagagagatgtacagaatcgttttgtactgtatcttgaaacttgtgaaataaagattccacctctgg

SEQ ID NO: 29287 - DNA, 469 bp, Homo sapiens
ggttctttaaaagagtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaacaacaaaataaccgaaatcaaagatggagacttt

SEQ ID NO: 29288 - DNA, 247 bp, Homo sapiens
aaaaccggaatgccattagaaggtaaaatgcatgcactctcaaattcaaggacctgtgctcttgagatcaatgaccatgaattaaactctcctctttccagcgtccaacacaagaaatgaagtcggggtttcccaaaacaccttcatgatttttgtttgcttgtttggtgtcctaccacctgtactactattgacttaatatttttctttaaatgtcctcaaatttttactcaaataaatttatttt

SEQ ID NO: 29289 - DNA, 471 bp, Homo sapiens
  misc_feature 20: n = A,T,C or G
ggtacaaataaaccccagangagttatgtttggcctcagcctgacgtttcatttgttgaaataagccccaaaggtctatgtgattttctcattcttgtaaacatagtcatattgaagtcgagcaattactttgcaattttgtacctgacaaggcatttccagcagaagtaaagagaaattcagatagactaaaacataaaggaaatggtttataagagtttcctaactcatacaatctttagggaagaaatagttgtatttttgtatcattaaataatttcctaaactcaaggttagaagatttctatcactcatctaatctaaaatcccatttatctggggaatgttggcaaggatgatatatttactataatcctgatgcattaaagaatttcagatgatcatcaaaatggaaatgtcatcttcatatcccaggagggtttatattctggcttttctaaagtggagagc

SEQ ID NO: 29290 - DNA, 173 bp, Homo sapiens
  misc_feature 173: n = A,T,C or G
ctcactcctcactgagtccactctgaacgtgctaaaatgggaaggaggcggtgttttgatgatctgttaaattcttagtgaagtttccttgatttccagtggctgctgttgtttgagtttggtttggagcaaaactgaggtagtcctaacatttctgggactgaatccaggcn

SEQ ID NO: 29291 - DNA, 251 bp, Homo sapiens
cagcaataactgctgaacccacaggttctaggatcttagagtgataggggattgtaaaaggcatttggtccaaactcttgacatcttgcgaatgaagaaacccgaggcagaaagccagtgcatgacatacggaaggtcacccctgtgtagctaaattgtaacataagctgaaacaccctcacccagcgcagtcctgtggaaatataatgtaagcagtaaatgtgatttttaaagtactggtagatacatag

SEQ ID NO: 29292 - DNA, 302 bp, Homo sapiens
  misc_feature 10, 38: n = A,T,C or G
aggaaacagnagcccttaagggcttgggaataacaagnaagagattgaagacagagaagcttgccctgttttccttgccccttcaaagaaaaggatttacagctcaaacttagaacagctgttgtccagctttagccatcaagagagaaataaattaaaccaccattgccagactacaagccctggtgaagtcagggtgtgggagtggtggcattgagaagactacctaaaagagacaaagactgcagtaaacaaagctcctctttaaagttggaaggggcctcaggttccttcttggatcg

SEQ ID NO: 29293 - DNA, 351 bp, Homo sapiens
  misc_feature 77, 92, 97, 115, 133, 136, 178, 199, 216, 227, 252, 270, 307: n = A,T,C or G
aaggatagaacaaaaccaagtgtgttgggggaagcaacagcaaagggaagacaagatgttgcaaaaaaaaaaatggnggggggattcccctntcctntggggaatgactcaaacnctgatgtggcagcgtacnctnttctacataaagccagggatgttaatccttttgggggataanaaaaagtggagatggccaggnttctgtggctcatgccnggtagtcccancactttgggaggcctaggcgggcanatcacctgaggacaggantttgataacagcctggccaacatggcaaaaccccgtntttactaaaaatgcaaaaaattacctgggcgtggtggcgggtgc

SEQ ID NO: 29294 - DNA, 339 bp, Homo sapiens
ctcctgatggtagtttctgtaccgactgagtttgtggttgctgacaatagaaactaactctaattaagtttaaacagaaaaaaaggtttgttgagaagatatgagatacttgatagaattgacaaaagaaaaaaaagccagagcattaggtttgaaataaaaagtaaattaggtagcctgctatcgactggattgtgtatccccacaattcatatattgaaggcttaacccctaatacgactatgtttgtaaatagggtttttaggaggtaattaaggttaaatgaagtcataagggtaggatctctaattggtggccttattagaaaaaggagagaga

SEQ ID NO: 29295 - DNA, 145 bp, Homo sapiens
catgctctttctactactccatacgctgcccctcagccctacaaaaatcttcaaaaatgagtgtttgtcatgccaattcttgaaataacttagatcgtaagtctttaaggccttttaataacgtgggaccaccccattgataaac

SEQ ID NO: 29296 - DNA, 427 bp, Homo sapiens
aagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatgggttttgggactagaggctcagtggtggggagagatccctgcagaacccaccaaccagaacgtggtttgcctgaggctgtaactgagagaaagattctggggctgtgttatg

SEQ ID NO: 29297 - DNA, 187 bp, Homo sapiens
ataacccagctttaacaatctcagccctcactcctctcactcagttccctgcatcagtattactttgaagcaaactcaaggcatcgcgtcattttgttaaataaccacatcattggctgggcgcggtggctcacgcctgtaatctcagcctcccaaactgctgcgattgcggaagtgagccaccatg

SEQ ID NO: 29298 - DNA, 463 bp, Homo sapiens
aagagcaaggagaagaaacacatctggtttggagaaatcatcaatggtggcttccatttcagctatggagatgacaatctggctcccaacactgccaacgtccagatgaccttcctacgcctgctgtccacggaaggctcccagaacatcacctaccactgcaagaacggcattgcctatctggacgaagcagctggcaacctcaagaaggccctgctcatccagggctccaatgacgtggagatccgggcagagggcaatagcaggttcacgtacactgccctgaaggatggctgcacgaaacataccggtaaagtggggcaagactgttatcgagtaccggtcacagaagacctcacgcctccccatcattgacattgcacccatggacataggagggccccgagcaggaattcgggtgtggacatagggccggtctgcttcttgtaaaaacctgaaccca

SEQ ID NO: 29299 - DNA, 401 bp, Homo sapiens
  misc_feature 314: n = A,T,C or G
ggactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaagggagaagaacactgtggacatctaattgaggcccacaaggaatgcatgagagccctaggatttaaaatatgaaatggtggtctgctgtgtgaataaataattcctgaagaatgnaagaagattaattttggggagttctttgacgaactttgatatgtggaaaaagtatttataatttattgtaagaagaaagtaaaatat

SEQ ID NO: 29300 - DNA, 155 bp, Homo sapiens
agaatacctaatgctagatgatgagttagtaggtgcagggcaccagcatggcacatgtatacatatgtaactaacctgcacattgtgcacatgtaccctaaaacttaaagtataataataaataaataaataagtaaaaataaaaatatgccttc

SEQ ID NO: 29301 - DNA, 277 bp, Homo sapiens
  misc_feature 223, 262, 269: n = A,T,C or G
gtctaggcgatgaggattttccgttacctcagggatcaaagtataaaatgttgaatgagaaacccgaagaccttgcatcgctgggctgaataacttgttttcttttttatggtgtccagactgaggtagggaggggacacactgacctagctgtaagaagtcaagggttgggacaaaacaaagttcaaatatatactggaatttgtgtgtgtgtgtgtttcanaaactgtgtgtgtgtgtgtgtgtgtgtgtgtgtgtgttntcagctngagaaaga

SEQ ID NO: 29302 - DNA, 267 bp, Homo sapiens
atcgctcagattgtgtggcctcgtaagattgtgcgtaataagtaaacaagcatctgtacacttgttaacttaatgagcttctgtatgtgacactttaagcctttttaaaaattaagtgctgggctatgcttggtgtctcatgcctgtaatctaagcactttgggaggctgaggaaggaggttcgctggaacccaggcatttgaaaccagcctgggcagcatagagacctcatctcttttaaaaaatttttaaaatagtaattatatg

SEQ ID NO: 29303 - DNA, 276 bp, Homo sapiens
  misc_feature 4, 5, 14, 45, 49, 58, 69, 101, 148, 176, 187, 211, 213, 273: n = A,T,C or G
gggnngtactgcgnaataaaatctcggtgttctatttattgtatngtgnttgcctgtnagaccttacgngtcaaggcatgaggcaggctaactaaactggngtgagtcaacatgccccctgagtgactgcccccagcccaggccagangacctcccttcaggtgccgggcgcaggnaactgtgtgtntcctacacaatggtgctattctgngncctacacctcatgtgtttgttgaaacatcaattgatattaaaaatgaaaagattattggnccg

SEQ ID NO: 29304 - DNA, 360 bp, Homo sapiens
  misc_feature 306: n = A,T,C or G
ggttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggcttgaaggaccaggagctgagccctcgggagccggtgctgcccccacagaagatggggcctatggagaaattctggaataaatttttggagaataaatccccttggaggaaaatggtccatggggtatacaaaaagagtntctttgttttcactcatgtacttgtacctgtctggattattcattattacatga

SEQ ID NO: 29305 - DNA, 173 bp, Homo sapiens
agcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcg

SEQ ID NO: 29306 - DNA, 408 bp, Homo sapiens
  misc_feature 9: n = A,T,C or G
attccgagnagcttcaaatctggatttgatataatgtaatttatgtaaacataaacagagatgaaatatgagaagccctaatattaatataaaacaaaatgagaacttggcatttaggtcacatagcatagctatgcgtactattttcctaactctatcttgataaaattgaaagttacccataaaaatgctactctgtggtctttcagcgcatattttttttgttcctggtgtggtttgaatttcatattgtgtttgtttttcttcattctcttcatcctcaccctgaaaccacagaaggtttttcagtggaaaggagagtattgtatcacacttcctggttggtgccaattagttccagcgtggactttctttatggctttattttggaatgatatcatattattg

SEQ ID NO: 29307 - DNA, 471 bp, Homo sapiens; identical to SEQ ID NO: 24804

SEQ ID NO: 29308 - DNA, 106 bp, Homo sapiens
  misc_feature 10: n = A,T,C or G
atggcgcggncgcagggactgtgtgtgtcctacacaatggtgctattctgtgtcaaacacctctgtattttttaaaacatcaattgatattaaaaatgaaaagatt

SEQ ID NO: 29309 - DNA, 386 bp, Homo sapiens
gggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagc

SEQ ID NO: 29310 - DNA, 248 bp, Homo sapiens
  misc_feature 247, 248: n = A,T,C or G
gaagttatgatcatttaatatattcatattaccaagactattatactggaagtggtttttgtgttataaaggtttaattttacataaggcagttacttaatgtgatttttaacccttaaaaaagtggagatgtatacatttgttaacaatgccatgaaagcattttctttctcctaaggaaaagtgaatttcttatcagaatatctggctggccctgtaatttaaattaaaataaaattttggagcnn

SEQ ID NO: 29311 - DNA, 474 bp, Homo sapiens
  misc_feature 5: n = A,T,C or G
caagnacaataaagaaataaagttttccgtgctacccagaaagctaatgttctatctgtggaaacccttcaggagcaacgatgtaacagaccagaaaaatgtaaccgatcactcatgctcctcagctctgaggaatgggggagaggtttgaagtcctatttcatgcatgagaagcaatacactcctgattcattaagttcctccctcctaggggtcagtaaacccatttctcctaaactacacagtgcttcccacactcttcctttaagccccatgtgtatttagggaaatttagccaaacaattcccaataatgcatagcgcactcatcaaaaagaaattaagcagctttgctaaaagcaactacattttcaggaatctacttgtggctttcccatacacctcttttctacaaaatggaagcattagaatacactaaaacccgggcacggtggcttatgcttgtaatcacagc

SEQ ID NO: 29312 - DNA, 466 bp, Homo sapiens
gttttatagtacacactcaacttcctttgtttaataatatttgtcagccctcagtaatgttgatgatgagatgccccctttcctgtctcactcttttcactgtcctgttagaaatagcttagactggccagccgcagtggctttggcctctaattccagcactttgaaaggctgaggtgggtagatggcttgaggtcaggagtttgagaccagtcgggcaaacataatgaaaacttgaacctactaaattaaaaaacattggacgggcatgatgtctcacacctattatcccaatattttgggaggccgagacgggtggatcactttgaggtcagaagttctagaccagcctggccaacatggtgaaaccccatctctagtaaaaatacaaaagttagctgggtgtgttggtatgaacctgtaatcccagcttctcgtgaggctgagacatgagaatcacttgaac

SEQ ID NO: 29313 - DNA, 163 bp, Homo sapiens
  misc_feature 2: n = A,T,C or G
anaaaaaattaactgggaatggtggcatgcacctgtagtcccagctacttgggaggctgaggaagggtaatctcttgaaccaggaggcagaggttgcaagtgagctgagatggtgccacgtccctccagcctgggcgacagagcaagactccgtctcaaaaac

SEQ ID NO: 29314 - DNA, 475 bp, Homo sapiens
  misc_feature 470: n = A,T,C or G
gaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaattttgaagacattggnggctt

SEQ ID NO: 29315 - DNA, 334 bp, Homo sapiens
  misc_feature 5, 6: n = A,T,C or G
tatgnnttatggcggggaccggaaatgagggcaaggaacacctggccggcccagggtggaaaaccccttaaaggcattcttaagccacaaacaatagcatgagcgatctgtgccttaaggacatgctcctgctacagttaactagcccaacctattcctttaattcggcccatcccttcgtttcccataagggatacttttagttaaattaatatctatagaaacaatgctaatgactggcttgctgttaataaatacgtgggtaaatctctgttcagggctctcagctctgaaggctgtgagacccccgatttcccacttcacacctctaaac

SEQ ID NO: 29316 - DNA, 265 bp, Homo sapiens
tgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacgt

SEQ ID NO: 29317 - DNA, 465 bp, Homo sapiens
  misc_feature 421: n = A,T,C or G
ctgtaaagaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttattgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggnatacaaatctgtctacatgaagtttacagattggtaaatatcac

SEQ ID NO: 29318 - DNA, 313 bp, Homo sapiens
  misc_feature 19, 51: n = A,T,C or G
gaaagcccttaaataaagnaggtaagaaacctaggaccaaagcacccaagnattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactccg

SEQ ID NO: 29319 - DNA, 103 bp, Homo sapiens
  misc_feature 7: n = A,T,C or G
tctctcngatctttatggcgcggggaggcattgaggcagccagcgcaggggcttctgctgagggggcaggcggagcttgaggaaaccgcagaataagtttttt

SEQ ID NO: 29320 - DNA, 482 bp, Homo sapiens
cacactgttaaaagttgtgttttgaaattttatgtttagttgcacaaattgggccgaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtttagcagtttctgcttcacatttgattttttcaaatttaatatttatattaagagatctatatatgtataaatatgtattttggcaaatttgtt

SEQ ID NO: 29321 - DNA, 323 bp, Homo sapiens
agtcttttgaaaaataatgatatatttttatttaaattacatttcaaggctgggtgcagtggctcatgcttatagttccggcactttgtgaggttgaggtggacagattacttgcccacctcaggagttcgagaagcagcatggcaaaaccccatctttacgcaaaatacaaaaattagctggatgtggtggagcatgcctgtagtcccaagtacttgaaaggctgagatgggaggatcgcttgagcccaagacgttgaggctgcagtgagccaagactgcaccactgcattccagtctgggcaacagagtgagaccctgtct

SEQ ID NO: 29322 - DNA, 399 bp, Homo sapiens
aatgttgaggataacgatgatgatgatgatgacaactacaaaagaagtagagaaagagggaggaagaagataaggtgatgatagagaagaaaaggaagagaggagcataatcttagaatttttaattgattggttattatgaactaggtgtaaagccaagcattttatgtactctatgaagtagtactgcattacttccattgccatatgcagagccagttatgcaagtggctttaataacaaaacttaaaaaagggatgctagatctcgaactaatgtctgctcaattttcaaagacaactttactagaattatatgctttgggaaaaataaataaacaggagtagaaagctcaatttgaaaaaaaatatatatactagtcatttcagtctctgtaca

SEQ ID NO: 29323 - DNA, 117 bp, Homo sapiens
ggggtgacggggaatcagggttcgattccggagagggagcctgagaaacggctaccacatccaaggaaggcagcaggcgcgcaaattacccactcccgacccggggaggtagtgacg

SEQ ID NO: 29324 - DNA, 232 bp, Homo sapiens
gggttatttgttttgtttttaatatatgcatttcttcaatgactttacagagtgaaattctatagaacaaaaaatgtttcttaggcccttcatttccctgactttattttttatttttattgtttctttagggacagagacagggtcatgctctgtcacccaggctggagtgcagtgagccgaggtcgtgtcattgcaccccagcctgggcaacaagagtgaaactccatct

SEQ ID NO: 29325 - DNA, 385 bp, Homo sapiens
gatcaagatgccgaaccctgtgttcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttatttacagccagaaagtgtgggctgaagatggttggtttcatgtttttgtattatgtatctttttgtatggaaagactatattttgtacttaaccagatatatttttaccccagatggggatattctttgtaaaaaatgaaaataaagtttttttaacga

SEQ ID NO: 29326 - DNA, 136 bp, Homo sapiens
aaatcttgaaggtaaagtaacaagcacctttggagatgagtatgcatccagcggcaagcgctccactctcagtctttactaaggaatctgcagcctccaaacacagtgaccaccatcaccaccatcaccatgagcg

SEQ ID NO: 29327 - DNA, 218 bp, Homo sapiens
atagcaaaatctgcattcctgaggctgggaactagaggaaagggtttgtgtctaataggaaccaattgaattttagaaaggatgttaacatatagctgttttactgtctataatgttaaatgaatacacttttggcctctgtctagaaaaaaataacatcttaatctagtgtgtgattcttatacataagactttttagggatgacagtaatatttac

SEQ ID NO: 29328 - DNA, 460 bp, Homo sapiens
  misc_feature 20: n = A,T,C or G
gaaggagtgaagaccccagnactgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgttt

SEQ ID NO: 29329 - DNA, 244 bp, Homo sapiens
  misc_feature 19, 25: n = A,T,C or G
gcttctttcccgggtaatntcggcntttatggcgggggagaagtttgaataattccttcctgaagttacctaaatagctttcaggattactcatcagaaactcttcaacatagggattgctcatctgaaacttctcaatgctgttttagctgaaattatagagtaccattaaatcactatttttttgctggagagaaacttaaactgaggataataatttaacagccagcctcataccactgac

SEQ ID NO: 29330 - DNA, 278 bp, Homo sapiens
  misc_feature 58, 275: n = A,T,C or G
ggtttctcgctaatgaattgagcagtacatctaatattttatatgccttttgagctgngtaaccttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcnttg

SEQ ID NO: 29331 - DNA, 466 bp, Homo sapiens
  misc_feature 225: n = A,T,C or G
caactcaggacgttgaggctgcattgggccgggatcatacctctacactccagcatgggcaaaggagcaagattctgtctcaaaaataaataaataaattttgtttttaattagccaggcatgatggcatgcacctgtagtcccagctattcgggagaccaaggtgggaggatcatttgagcccaggaatttgagactgcagtgaactatgatgatgccactgcnttccaacctagatgacagaaggagacctcatctctaaaaataaatatatatatttttttccaaccactttttatctataccccaatgtcttacattccataaaacatcatgttttgaattccagtataactttatcgttaaacatgtttctttgcagaagcatgtataagttagggtccacaagattatttgcataagctaatttacaaaaaaaattatataatcactgacatgaaagcat

SEQ ID NO: 29332 - DNA, 416 bp, Homo sapiens
caataaatgatgtttgagacaattgggtatccatatggtaagtattaaataaaattcagttccaagtggattgaagatttaaatgtgaaaggcaaaactgtaaagcttctaaagtataatcagaaacttacagaagactttaaaaagttggccaggagcagtggctcacactgtcccagcactttgggaggccaaggcaggtggatcacctgaggtcaggagttcaagaccagcctggccaacatagtgaaaccccatctctactaaaaatacaaaaattatccaggcgtggtggcaagtacctgtaatcccagctacttgggaggctgaggcaggtggtagaaggtggaggttgcagtgagctgagatcacaccactgcactccagcctgggcaacaagagtcaaactccatcac

SEQ ID NO: 29333 - DNA, 464 bp, Homo sapiens
gtactaaggacccgccaacatgggccgcgttcgcaccaaaaccgtgaagaaggcggcccgggtcatcatagaaaagtactacacgcgcctgggcaacgacttccacgcgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatct

SEQ ID NO: 29334 - DNA, 434 bp, Homo sapiens
gagtgaccctaagcttgggggactgtccactgggagttggagtgagcacgtggtgctgcaacaggcattgttttacatactttgtctccagtattctgacaccaagtgtcaactgtggtactttctttgcctaggatatgaattcataattgttgcttttgttgatggttgataccctttccattgatttaaacctaacacattatttctattccacatgcccagtagacatatattccaaagccactggaccacttgagtacataagtgccactgtttaatgcaatatgtatattcaggtctgtaaagctaacagtgtgacttggagtgcttcctgcagatgattctgacttgagtatttacatggaccatggtgatatccaaaagaaaaatgctttttatatttatagattatttcattgaactatatatga

SEQ ID NO: 29335 - DNA, 466 bp, Homo sapiens
  misc_feature 1, 17: n = A,T,C or G
naggataattatttttnagtgactattaagtgcatgaaactcttgatcccttatatttataacccaataattatacaggcctcacttttcaaaatcagagaaagccttgttattgagatttaaagacaacattttcctaaaaggagatcatctcagaaaactatagagattaagaattttcagtagtcagattaggtctgagttctagcccttccatttactagaggggtaagctttcaattccctaagcttcagttcctcctatataaaatagagataataaataatacccccctcataaggtagagcaaggagtcactaaaataaattatgaaaagggcttagcatagcgtccagcacgtagtaagagtgctcaataggttcagttattattcatcatgatatggcattaataatacataagataagagacctttgttggacccaatctgtggcctcaggcatc

SEQ ID NO: 29336 - DNA, 138 bp, Homo sapiens
ggctcatgcctgtaatcctagcactttgggaggtcgaagcggatggatcactgttggccaggctggctggaactcctgacctcaggtgatcacaccattgcactccagcctgggtgacagagcgagactttgtttcga

SEQ ID NO: 29337 - DNA, 191 bp, Homo sapiens
  misc_feature 5, 154: n = A,T,C or G
aaaanaaaaatttgaaatctggttaggctgatgttagggttctttgtttttggggtttggcagagatgtgtttaagtgctgtggccagaagcggggggaggggggggtttggtggaaattttttgttatgatgtctgtgtggaaagcggctgtncagacattcaattgttattattatgtcctacaagcat

SEQ ID NO: 29338 - DNA, 248 bp, Homo sapiens
aagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatct

SEQ ID NO: 29339 - DNA, 316 bp, Homo sapiens
  misc_feature 10, 11: n = A,T,C or G
gtatttctgnnttatggcgcggggttttaaaaatatctggccggtgtggtgactcatgcctgtaatcccaacactttgggaggccaaggcaggtagatcacctggggtcaggagtttgaaacgtttggccaacatggagaaaccccagctctactaaaaaatacaaaaattagccaggcatggtggcatgagccttgtactcccaactactcaggaggctgaggcaggaaaatcacttgaacccaggaggcagaggctgcagtgagccgagatcacaccactgaactccagcctgggtgacagagcaagactccat

SEQ ID NO: 29340 - DNA, 467 bp, Homo sapiens
gtgagaaagtactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgag

SEQ ID NO: 29341 - DNA, 368 bp, Homo sapiens
  misc_feature 2, 22, 33: n = A,T,C or G
tnctgtattttaaaaggtaagnacttcagtatnctgtaaaaaagaaaaaaataaataaaaaggtacaacttcaaaacatgtcgagtactgacggacagagctgcaggaaagaggtaactgagagtagatgaagctgttaactcacccatgttcctcaaaaacaaacaaacccatgtcctcctggcaaaaactcattcatcaacggggactggttggcttgagtcatgaggcacaggaggtctaaccttacaggtagatgattcactttctctttcggcaaacagaccatgcctagaatctcatcataccaggccacagagcaagtctcaattcatttcaaatgtaacacaataaaatttgaaaccaac

SEQ ID NO: 29342 - DNA, 338 bp, Homo sapiens
  misc_feature 245, 270, 277: n = A,T,C or G
gtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtatatatatatatgnacagttatctaagttaatttaaagntgtgtgngcctttttatttttgtttttaatgctttgatatttcaatgttagcctcaatttctgaacac

SEQ ID NO: 29343 - DNA, 304 bp, Homo sapiens
cgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaac

SEQ ID NO: 29344 - DNA, 500 bp, Homo sapiens
  misc_feature 3, 20: n = A,T,C or G
tcngtcttatggcgcggggnacaatgcaactttttatttaaaaaagctctgcactgccatgtatgaaagtctctttatgatgtttgtttttttgtcatttttgttctttacatcaagaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaatttgaagttaacattcttattttcaagagaatttatggacgttgtagaaatgtaca

SEQ ID NO: 29345 - DNA, 464 bp, Homo sapiens
  misc_feature 442: n = A,T,C or G
aagtgaaaaaaatacagtatttgtagataaccatagctactacacagttcttcggtagtcccagtgtagttatatcagtgtttactgaagggaacatcaaaatattaatggtatattataaaataaagactttcttaaaggaaaattgcacctattttacctttttaagagtaagccatgaacttgtaacatgtctcttaactatttataatgaaaagtggcatttgggtatagtcaccacagcaatgttctacatccctaagattatctaggtaggacatgtcaaagatgactgttgtcattctggaggtcctattagagaatattataaaagggtgaccttgtaggaaggatctgagtcctccccctgaggttctctttttcttggtgctttattagcaactctggatatttttataaaactagttacattataaacggnttcaaacatgtttaatttacat

SEQ ID NO: 29346 - DNA, 339 bp, Homo sapiens
  misc_feature 338: n = A,T,C or G
ccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggnt

SEQ ID NO: 29347 - DNA, 256 bp, Homo sapiens
  misc_feature 12: n = A,T,C or G
aggagttcaagnagcagcctgggcaacatggcagaaatccttctttacgaagaaacgcaaaaaacaagctgggcgttggcgcgtgcctgtagtcccagctgctcagaaggctgaggtaggtgggaggatcatttgagcctgggaggtcaaggctacagtgagccgtgatcatacaaccctgtactccagcctggatgacagagcaagactatgtctcagaaaaacaaaacaaaacaaagcccaccaacacaacagc

SEQ ID NO: 29348 - DNA, 463 bp, Homo sapiens
attgagtatgatgtcagctgtgtgtgggtcatatatggcctttattatgctgaggtacatttcttctatacctaatgtgttgagagtttttatcatgaaaggatgttaaattttatcagatgtatctattgggatgattacatgttttttatccattctgttaataggatgaatcacattgatttgcatttgttgacaaggtctatccttgcatcccaggaataaatcccatttgatcagggtgactgatccttttcgtgtgctgttgaattcagtttgctagcattttttgtttgagatttttgcatctgtgttcatcaggcatattgacctatagtttccttttcctgtagtgtctttggctttagcatcagggtaatgctggcctcataaaatgaatttggaagtatttactcttcttcagttttttgaagaatttgagaggaattgttctttaaatttt

SEQ ID NO: 29349 - DNA, 303 bp, Homo sapiens
  misc_feature 13: n = A,T,C or G
gtgtgtctaaagnaatgacatatggttgggtacggtggctcgtgactgcaatcccaacactgtgaggctgaagtgggaggatcacttgagcccaggaatttgagaccagcctggaaaacagtgagacctgcatctctacaaaaaaacaaaaaattacccaggcatggtggtacacaccttgtggtcccagttgcttgggaggctgaggtgggagaatcgcttgagcctgggagatcaaggctgattgaagtctcatcacgccactgcactcgagcctgggtgacagagcaagaccctatctcg

SEQ ID NO: 29350 - DNA, 145 bp, Homo sapiens
  misc_feature 3, 8, 47, 58: n = A,T,C or G
atngcggncaagtgtagtcgttctgtgaatgctagctctcttgaatntggatattggntattttttatagagtgtaaaccaagttttatattctgcaatgcgaacaggtacctatctgtttctaaataaaactgtttacattcat

SEQ ID NO: 29351 - DNA, 468 bp, Homo sapiens
attgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattc

SEQ ID NO: 29352 - DNA, 469 bp, Homo sapiens
  misc_feature 257, 292, 321, 323, 400, 426: n = A,T,C or G
gtagatggcagtgtgatactgtaaattttgtactcaaagtctttgtcttttctaactctttgtcttttctaactcttaaaatgttttaataattaagatatggaatatcaatattccaaagtaatatttagagaaactatatgcttccttcttaagatgaaattaaaatctgcttatgaaacatggagaagtctgcccaaacatgctaacttggctttcttatttgtgattctgtcactttttttttttctgttaanatttacaggcaaacatatgggcgacatggtatttnaagggatttttctccctaatatcttaagngnggcattaacttaattcctgaggaaatgtataatcttcatgggaaaataatatggattacaagggtcttaatgcaagngttcttttgaatattataaaacttgngactcttaaacacaaattgtcccagcatagagccctgaaggac

SEQ ID NO: 29353 - DNA, 349 bp, Homo sapiens
  misc_feature 3: n = A,T,C or G
tcngtttttatggtcgcggggaaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttg

SEQ ID NO: 29354 - DNA, 323 bp, Homo sapiens
  misc_feature 4: n = A,T,C or G
gacnacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttt

SEQ ID NO: 29355 - DNA, 336 bp, Homo sapiens
  misc_feature 3, 5, 40, 46: n = A,T,C or G
ctntnttatggtcgcgggatcccaccgccctacgacaagnaaaaancggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcc

SEQ ID NO: 29356 - DNA, 104 bp, Homo sapiens
agtgatgatgaggcagaggtaagagaaaggtgagaaagaagaggaagataaagatgatgaagaaaaacccaagaatcgaagatgtgggttcagatgaggaggat

SEQ ID NO: 29357 - DNA, 122 bp, Homo sapiens
gacagctagtagacctggagtgataaccactctaaagctgatttatacgcacctgaatgtaactaagtagatatgactggaagagtggcaattttgctgctgagtccatatctagacatgcc

SEQ ID NO: 29358 - DNA, 465 bp, Homo sapiens
ggtgaagagacatgagaggtgtagaataagtattataacccccttttgtgaatgagaaaaccaaagctcagttctgtttatagtttgccaaggctacactggtaagtaaagggttcagccaatgtatagacagactgtatagatatatgaagtgggggtgggggccaaggagctattactgctgtttggaaatacttgcctcttgtagatccagctttaacatttttatgacatcctagtaatagcagaccctgcacaaagtggatatcagagttaatactgtgaagagacaaaataatgagaatacttttaccaaagataatgaaatcttgcataatgtctgcatttttccattgattggagtgcatccttagaaaactgaaaataacaaaaacccaggacatttttggaaattgtatgctctctagcaactttgcgtgaatttttatacaaacacttatgagt

SEQ ID NO: 29359 - DNA, 216 bp, Homo sapiens
gaggtcaggagttcgagaccggcctgaccaacatggtgaagccctgtctctagtaaaaatacaaaaattggctggtgtggtggtgcatgcctgtagtcccagctactggggaggctgaggcaggagaatcacttgaaccctggcggtggaggttgtggtgagccgagattgcaccgttgcactccagcctgggcaacaagagtgaaactctgtccg

SEQ ID NO: 29360 - DNA, 455 bp, Homo sapiens
  misc_feature 21, 24: n = A,T,C or G
attgatggtagcaggcaaagnagnagaggttgtgcagagaagctcttgtttttaaaaccatcagaccttgtgagacccattcactatcacgagaacagcatgggaaagacctgcccccatgattcagtcatctcccactgggttcctcccacaacatgtgggaattatgggagctacaagttgagatttgggtggggacacagagccaaaccatatcagttagtgattaggaaaatgcaaatcaagatcacaagacaccacttcatacccactaggatggctataggcagagagatggaaaataacaagtgatgataaggacatggagaaatcaaaaccctcttacaatgttagtgtgaatttaactaattcaggcacttaaaaaaactgtttaggtgtgcctcaaaaggtaaacatagactctcaaacccaacaattctacttctagatatata

SEQ ID NO: 29361 - DNA, 224 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgg

SEQ ID NO: 29362 - DNA, 259 bp, Homo sapiens
gggtgggaacggcgccgagtcagtgtacacgtcggttgcctaacaaccggcagcggactcctttggctatggcctccaactttaagaaggcaaacatggcatcaagttctcagcgaaaaagaatgagccctaagcctgagcttactgaagagcaaaagcaggagatccgggaagcctttgatcttttcgatgcggatggaactggcaccatagatgttaaagaactgaaggtggcaatgagggccctgggctttgaacc

SEQ ID NO: 29363 - DNA, 465 bp, Homo sapiens
  misc_feature 402, 449, 462: n = A,T,C or G
ggctccgaaaccttctgccttcttgatacctctacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttgggngagtcaaaattagagtataatatggaaagtaatgtgaaatacatatntgaaatacatatntga

SEQ ID NO: 29364 - DNA, 173 bp, Homo sapiens
aaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggcc

SEQ ID NO: 29365 - DNA, 352 bp, Homo sapiens
agggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatataatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttc

SEQ ID NO: 29366 - DNA, 126 bp, Homo sapiens
  misc_feature 8, 31, 43, 45, 47, 48: n = A,T,C or G
tcccgggntaaactcggccttatggcgcggngagctactaggnananncttatttcactaaatgtaaaatttggagtaaatatatatgtcaatatttagtaaagcttttcttttttaatttccagg

SEQ ID NO: 29367 - DNA, 451 bp, Homo sapiens
  misc_feature 11, 30, 183, 331, 401: n = A,T,C or G
ggatctgaaanagcctttctggggaggagnaagatgatgagcctgattgctgtaacgatgagcggtactggccagctggacaggaaccttccctcgttcccgacttggatcctttggaatatgctggcttagcctcagtggagccttatgttccagaatttacagtctccccatttgcagtgnaaaaactttccaggtatggtttcaatactgaacgctgtcaagcggtcctgaggatgtgtgatggagatgtgggagcatcactagagcatctccttacccagtgtttttcagagacatttggagagaggatgaagatctctgaggcagncaaccagataagcttggatgagtgtatggaacagcgacaggaagaggcatttgctctcaagtccatctgnggagaaaaatttttagaaagaattcagaacagagtctggaccattgggtt

SEQ ID NO: 29368 - DNA, 464 bp, Homo sapiens
  misc_feature 3, 4, 5: n = A,T,C or G
agnnnaactgctatgaaaacaaaagtaaaacaaagtggtattactaacaagccaataatggagataaaatgggcaatagaaaacaacaacaaaaattcaatccaaaagaaggaaggaaaagcttaaaagtgagaaaaagaacatatgggcagttagaaaacaaacaataaagtggtagatataaactgagccatgctgacaattacattaaatttaatgacctaaacactctaataaagcaaagattgtcagacagaataaaatacaaggtccaactatacgctctgtacaagaaactcactttaatataataacatgaataagttaaattaaaagatgcaataaaagacatattatgctaacactaattaaaaaaacagaaatgattatcagagaaagttgatttaggagtaaggaataatgcaaaggatacagaggaacattttaaaataaaggggtcaatt

SEQ ID NO: 29369 - DNA, 297 bp, Homo sapiens
  misc_feature 296: n = A,T,C or G
gatgaactgtctggaattacataaatataattgagaatatggataggaaaaaaaatcatcaagactcaggacaatggcagaacccaatccaaggaaaataagaataacaataaagtgttataggagctgaaggacaaagtagctggtataataaaaaaagaaactaactgatctgaaagcgccaaataacacaatacaagaatttcacaatgcaatcacaagtattaacagcagaaaaaaccaatctgaggaatgaatctcagaacttgaagattggttctctaaaataagatggnc

SEQ ID NO: 29370 - DNA, 462 bp, Homo sapiens
  misc_feature 429: n = A,T,C or G
aacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaacctttactacaattagtaagtatggngcagaatttcatgcaaatgaggagtgccagcag

SEQ ID NO: 29371 - DNA, 122 bp, Homo sapiens
  misc_feature 37: n = A,T,C or G
aaggagaagtcctcgtggggagagggacagagacagnacagagggagaggagaagagacgcaaaagaccgggagaaagaaaagctgaaggagaaacatcgagaggcagaaaagtctcacagc

SEQ ID NO: 29372 - DNA, 323 bp, Homo sapiens
aagaaaaatttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagt

SEQ ID NO: 29373 - DNA, 484 bp, Homo sapiens
  misc_feature 18, 20: n = A,T,C or G
gtcccggggtatttcggntnttatggcgcgggcatccgtttgctagtaaaatcccagtacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgatttcaagcacacaaaatcctttataatttaaagactccactttagagatacaccaaagccacccgttgttacacaaggttattaaactattataaaact

SEQ ID NO: 29374 - DNA, 220 bp, Homo sapiens
  misc_feature 10, 24, 26: n = A,T,C or G
atttttgtcncggggtatttcggntnttatggcgcgggggcacccattggggatcttggaacatggataaatgaggactgatgtatttaccagaagacatgtaaaataatgtttatagtaggattattcaaataatcaaaaactggatgtaaccttgattacaaaaccagacaaggaaacacacacacacacacacacacacacacacacacacacacac

SEQ ID NO: 29375 - DNA, 464 bp, Homo sapiens
gaaaaggatattataagatgaagtactgttggaattgttgacaaagatttgggacacaaagccttttgtctagaagataatgaatcagagcagatatatacaacctaatcctacaggaaaagaatagctcctagaccaaaaatactcacatgtaacctgattgatggtattaataatttttttaaatgtatcagaaatagatttgattagtaaaagaagtaaagaaggatagtcaagaagcaaactttgacaatgtcagcttaaacagcgggaggtttccctgcccacgggaataacctggtccctgattcaagcaaacggttactgagtttgtattatgttctaaatactaggcattattatgaaaaggcaagacgtgattcctgtatcaagagtgtagaaccttctgagggagaattcaacactcctcttgagaagaggaatgcattattaattcttaagac

SEQ ID NO: 29376 - DNA, 334 bp, Homo sapiens
  misc_feature 10: n = A,T,C or G
gaaattaagnagcaaacttttaaataactgatggccaaaggaataatcataatagaaatttaaaatacttacaactgaataataaaatacagtgcatcaaaatttgtgggatgcagctaacatgggacttattattttagcctgttctcacactgctataaagaaaaacccaacactgggtgatttataaggaaaacaggtttaattggcttatggttctggaggctgtacaggaagcatggtgcttggccccattcctggctcggcctctggagaggcctaagggaagcttacaatcacggcaggaacgcagagtgagagtaacactccacat

SEQ ID NO: 29377 - DNA, 400 bp, Homo sapiens
gcttgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaacccgcttccaccaccatggtgtttgtttctagaacttttgccagtcctcgaagaatgggttctgtgtctaatcctgaaacaaagaaaactgcaagctggagtgtaggaattgactatagcaatttgatacatttttaaagctgcttcctgtttgttgagggtctgtattcatagaccttgactggaatatgtaagactgtgc

SEQ ID NO: 29378 - DNA, 395 bp, Homo sapiens
catgtcatattaagtacaggtgtgtagggggtgtgcagagttttctcagcaagctcacatgagtcctgtgtttaaaaattttgcagtagtgtaattcttgtagcgatatcagtctttatgggcattctaagcagaaatatactaaaatgaagtttgttttgttaaatgtggcttccccagtcattctcgaagagttgtcgaatgggtggttgcagtttgttttagttaacttacataatgtgtttttaaatagtgtaaataaaatagacatgttatttcaggaaagtgaaaaatgttcagttttttcctttgtgtccagactcagaaactaaagctatgtcataatatcttaggccaagggctggggaaatcaaacacaatttgtacttacacat

SEQ ID NO: 29379 - DNA, 372 bp, Homo sapiens
  misc_feature 10, 16: n = A,T,C or G
tggtcgcggnctatanaacttttttcaggataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagc

SEQ ID NO: 29380 - DNA, 490 bp, Homo sapiens
  misc_feature 2, 9: n = A,T,C or G
anagccagnagtatagtttcgtgggggtttttgtttgcttgtttattttttattagagtaatttaagtacattatacttgcctatgcactcctttaaaattttactttaaatggaaatgatactacaaggataatttttaaaactttttattatgaacattctaaacaaaagtagagaaaacttatatatccattatgatgaatctcctattactcattgttcagcttccacaatcatgaactttctgttcatcataggacaattcttaactaattgtaggtacatcatctttattactgttttatataacaagtattgctttcaaattcctatttatgttgtctactctgtttactttcctttttcttacctaaatgatcttcaagcaccttttatcatttaactgtctctctgttctaggaaaggtatgaaccagcagcctgagagagggaggccagctatgctttttttggtactttgcagcaacct

SEQ ID NO: 29381 - DNA, 210 bp, Homo sapiens
  misc_feature 3, 16: n = A,T,C or G
ganacaggatccgganctggtgctgataacagcggaaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctag

SEQ ID NO: 29382 - DNA, 445 bp, Homo sapiens
  misc_feature 2, 16: n = A,T,C or G
angatgggtcgtgagnactaagaccatggcaaaagttataaccaccgtactgaagttccctgatgatcagactcagaaaattttggaaagagaagatgctcggctgatgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttat

SEQ ID NO: 29383 - DNA, 167 bp, Homo sapiens
  misc_feature 32: n = A,T,C or G
gaacgactcttagtcggtggatcactcggctngtgcgtcgatgaagaacgcagctagctgcgagaattaatgtgaattgcaggacacattgatcatcgacacttcgaacgcacttgcggccccgggttcctcccggggctaccccttgtcttgagcgtcgcttgccg

SEQ ID NO: 29384 - DNA, 429 bp, Homo sapiens
  misc_feature 6, 26: n = A,T,C or G
atggcncgggaaatgccagtctcagnatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatccta

SEQ ID NO: 29385 - DNA, 435 bp, Homo sapiens
caggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtatgctgacaggacccactctttcat

SEQ ID NO: 29386 - DNA, 482 bp, Homo sapiens
  misc_feature 2, 5: n = A,T,C or G
cnttntggtcgcggggttctgcaattttcgctaaggggttgttaacgctgaaaccgcactgggcgtcctggggtcaaaaaaacaatactagccacagtttattaaactgcaactaaatgccaggctatgtgcgccaaacttttaatattaatggttgtaggcacctttcttgaacacccaccactatcagccagtcactgagccagatccttcaaaataacagtaaaaatatagataatctacagtttattgagcacttcatctgcatcaagccttgttaaggggtttccatgcataagctctcattctcacaatagaacggtggaggtaaactattgccccatttaacatttaacatgcagtcctgtagacccagctactcggaaggctgaggtgagaggacccaggagctccaaacttaagtgagctatgatcgcgccactgcactccagcctgggcaacagaacgagacctgtctcaga

SEQ ID NO: 29387 - DNA, 168 bp, Homo sapiens
actcctgtaacgtgctaaaatgggaaggtaggcggtgttttgctgatctgttaaattcttagtgaagtttccttgatttccagtggctgctgttgtttgagtttggtttggagcaaaactgaggtagtcctaacatttctgggactgaatccaggcaagagaaagaag

SEQ ID NO: 29388 - DNA, 291 bp, Homo sapiens
  misc_feature 5, 6: n = A,T,C or G
cgagnncatgacgttcgaattgatagaaactcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcct

SEQ ID NO: 29389 - DNA, 267 bp, Homo sapiens
atgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatgaga

SEQ ID NO: 29390 - DNA, 205 bp, Homo sapiens
atggtccgggaaaactagtattagtgctttctagcaaacggttctgttaattagcgagtcactgttgattctgctgtggtggtaagttgataccgtgtaactaatcccgtggatgcctcctggttatttttgtccaaacgaagcagccgtggtagtagctgtctatgattcttgctcagcaaagtaaaataaatgttaaatatgg

SEQ ID NO: 29391 - DNA, 444 bp, Homo sapiens
gtgcttatgtcacaaaatgaagcaatagtcaatattgtctcaagccaaggaactttctgaaatgcattcgatttaaataaataacccgattacgagcctgaggaagtttatgaatgatgcaacaggaaatggagccaaatcttttagagatgatatttgagtgccttcaaacaaacacccagattttcagacacttgacccgaatttcatcagtcttattccagtctattccagctgcaatggatccaggatagcaatggcgggggggatctgtagtttccaaataatgtacagggcaaaaaacagagctggctccaggtttgattagagatttttaagaggtgctcttttctgcttctatttgtgtttttactagaaagtattattataaaaatacttctgtgaaaaaagtgtggatagaagaatgatgtcactgagaactct

SEQ ID NO: 29392 - DNA, 486 bp, Homo sapiens
aaaccttatccaaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaag

SEQ ID NO: 29393 - DNA, 350 bp, Homo sapiens
  misc_feature 2: n = A,T,C or G
tntggcgcgggaaatattgctgagttagtacatttgaagtaaacagtgttagctcagtgattataaagatgaagaaacagctggacacggtggttcacacctgtaatcccaacaccctcgaggcaggtggatcatgaggtccagagttcgagaccagcctggccaacatagtgaaacctcgtttctactaaaaatacaaaaattagccgggtgtggtggcacgcgcctgtagtcccagctactcgggaggctggggcgggagaatcgcttgaacctgggaagcagaggttgcagtgagctgagaccatgccattgcgctccagcctgtgtgacagagcaagactctgtct

SEQ ID NO: 29394 - DNA, 226 bp, Homo sapiens
  misc_feature 2, 5, 27: n = A,T,C or G
cnttntggtcgcgggttcgttctagangctttgagaagcctttgtgtattaaactaagcactattttaaaaactaaattgcatgtaatttttactatgcagatttttgtacatggttttatatgtacaagacataatatatatttctaatttcccctatacattacatatatttttatatatatatttacagacagagaaatatatatctatttctaacttccccc

SEQ ID NO: 29395 - DNA, 480 bp, Homo sapiens
  misc_feature 8, 9, 13, 30: n = A,T,C or G
aaggcaannaaantacaaaggaaggccagnatagccgcgcagttctctgcaggtgcagatgcaggcagtggaggtggcctgagcaggcagaaggacaccaagcgccctatgttgcttgtcattcatgacgtggtcttggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgtt

SEQ ID NO: 29396 - DNA, 108 bp, Homo sapiens
aaataatattttagaaaaatgtttggaatttaagaaataacttgtgttactaatttgtataacccatatctgtgcaatggaatataaatatcacaaagttgtttaact

SEQ ID NO: 29397 - DNA, 186 bp, Homo sapiens
  misc_feature 2, 31, 186: n = A,T,C or G
gncccccagagtgattatatactgatccatnggctgtgcctgatgatttggctggatggtcagggatttggggacttggaaagagtatgattggaagattggtgacaaagaaagctgggggcctggcatgagccactgcgcccgggccgacatcatctctataaattttttttttttttaaataan

SEQ ID NO: 29398 - DNA, 328 bp, Homo sapiens
  misc_feature 6, 11, 31, 33, 40, 206, 228, 267: n = A,T,C or G
gttggngagantggagacagtactgacgcgngnagccacnggtgttggagcagctcacagggcagacccctgtgttttccaaagctagatacactgtcggatcctttggcatccggagaaatgaaaagattgctgtccactgcacagttcgaggggccaaggcagaagaaatcttggagaagggtctaaaggtgcgggagtatganttaagaaaaaacgacttctcanatactggaaactttggttttgggatccaggaacacatcnatctgggtatcaaatatgacccaagcattggtatctacggcctggacttctatgtggtgct

SEQ ID NO: 29399 - DNA, 258 bp, Homo sapiens
  misc_feature 37: n = A,T,C or G
gcgcggggaaaacgcttttcatctgtcccgctgcgtnttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgaaaagggacgtcagacaagtgcagctgctg

SEQ ID NO: 29400 - DNA, 208 bp, Homo sapiens
  misc_feature 2: n = A,T,C or G
antccagaacatgtggatcttctggtctgcagccttgacaaacttcagagttcccttgtctccttgtacagatgtgtgtaccttttgatcatgaaggcactattaatgtccttcagagtttgtgtcaatttgcaactttgaaggatatccaaattatcaaataatttacatatgatgattattaaattgaagtttctaatttattctt

SEQ ID NO: 29401 - DNA, 263 bp, Homo sapiens
  misc_feature 18: n = A,T,C or G
atggtccggggggctggntggtgttattaatttaacaatcctatgtgaaactgttaattattggcactgaggcagcctggaaggagatctgaaaatgagtacagtagggttctattcttggccttgatctgttcaacattttcccagtgttggcggtgaagacagagaaggcgcgctcatcagatttgttagtggcgcagaagtgagaggaattgctggttttgcagacaaatcaaggttcagtcgtctagaattaggagtgc

SEQ ID NO: 29402 - DNA, 130 bp, Homo sapiens
  misc_feature 44: n = A,T,C or G
gtatattctcttgtctggctgcacccctttttcccgcccccagnattgataagtaatgaaagtgcactgaagtgagggtcaaaggagagtcaacatatgtgattgttccataataaacttctggtgtgat

SEQ ID NO: 29403 - DNA, 481 bp, Homo sapiens
cggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacacttttgtgagaaccaatgggaaggagcctg

SEQ ID NO: 29404 - DNA, 209 bp, Homo sapiens
  misc_feature 1, 6, 28, 195, 209: n = A,T,C or G
naagcngttcgtcgtggcaacgttgctnttgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgntctggtaaaaagcn

SEQ ID NO: 29405 - DNA, 128 bp, Homo sapiens
  misc_feature 5, 24, 39: n = A,T,C or G
ctttntggcgcgggaatcaaaagnaaactaccatcaggntgaacaggtcaaccctacagaaatgggagaaaatttttgcaatctactcatttgacaaagggctaatatccagaatctacaaataactc

SEQ ID NO: 29406 - DNA, 287 bp, Homo sapiens
  misc_feature 4, 13, 26, 35, 44, 45, 57, 58, 61, 75, 90, 92, 93, 100, 117,141, 160, 208, 217, 238, 244, 266: n = A,T,C or G
gtancaatgaagncttcctgaacctnccatgtatnctcaatgcnnggtgattaaccnncgntatcaaccaccaanctaaaggatgatgangnngctcagntcaagaaaagtgcaagntaccctgtgggacatccagaaggncctaaaagacctgtgactngtgagctctaggctgtagaaatttaaaaactacaatgtgattaactcnagcctttanttttcatccatgtacatggancacagnttgctttgatcttcttcaatangtgaattcgggctcacagaat

SEQ ID NO: 29407 - DNA, 490 bp, Homo sapiens
  misc_feature 33: n = A,T,C or G
aaagtcattaatttattctttttattgaaaagnattttgcctctaagggaactgtcaagaggcatgtgaaccagagcaactgcatcttaaataggagctgagtaaaatgaggctgaaacctactgggctgcattcccaggccgttaaagcattctaagtcgcagaatgagataggaagtcggcacaagatacaggtcataaagaccttgttgataaaacaggttgcagtaaataagccggctaaatcccaccaaaaccaagatggccatgaaagagacctctggtagtccttactactatactcctatcagcgccatgacagtttacgaatgccatggcgatgtcaggaagttaccctatatggtcttaaaaggggaggcatgaataatccacctgtttagcatatcatcaagaaataaccgtaaaaatgggcaaccagcagcactcagggctgctttgtctatggagtagccattcttttcttccttta

SEQ ID NO: 29408 - DNA, 419 bp, Homo sapiens
  misc_feature 5, 27, 33: n = A,T,C or G
atggnccgggaattctcggaagcaagnagcagnagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattg

SEQ ID NO: 29409 - DNA, 399 bp, Homo sapiens
  misc_feature 2: n = A,T,C or G
anactttactttttcctttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaac

SEQ ID NO: 29410 - DNA, 205 bp, Homo sapiens
aaacttaatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtg

SEQ ID NO: 29411 - DNA, 459 bp, Homo sapiens
  misc_feature 2, 4: n = A,T,C or G
angnaagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttggtcaatatgattttaaatgatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatatgc

SEQ ID NO: 29412 - DNA, 161 bp, Homo sapiens
  misc_feature 61: n = A,T,C or G
aaaacgagttcatgattatgatatgagggtggatgacttccttcggcgcacacaagctgtngtcagtggccggagaagtagaccccgtgaaagagaccgggaacgagagcgagaccgtcctagagataacagacgagacagagagcgagatagaggacgtg

SEQ ID NO: 29413 - DNA, 139 bp, Homo sapiens
  misc_feature 2, 5, 29, 51, 78, 84, 123: n = A,T,C or G
angcntgaggcagccagcgcaggggcttntgctgagggggcaggcggagcntgaggaaaccgcagaataagttttttnctcttngaaagatagagattaatacaactacttaaaaaatatagncaataggttactaaga

SEQ ID NO: 29414 - DNA, 500 bp, Homo sapiens
gtgatggcccggggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcaca

SEQ ID NO: 29415 - DNA, 500 bp, Homo sapiens
tatggccggcagcccaacttcaaataatggctccaggttatggagatgttaggttgtctttggaggcaataccagataccgtaaaccttgaagaaccttttcatattacctgtaaaataacaaactgcagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttct

SEQ ID NO: 29416 - DNA, 290 bp, Homo sapiens
tgcagtggctcacgcctgtaatcccaacactctgggaggccaaggcaggcagatcacaaggtcaggagatcgagactatcctggccaacatggtgaaaccctgtctctactaaaaatacaaaaaattagctgagcatagtggcacgtgcctgtaatcccagctacttaggaggctaggaggctgaggcaggagaatcacttgaaccagggagttggaggttgcagtgagtcaagattgcaccactgcaccccaccctagcaacagtgcaagactctgtctcaaaaaaacc

SEQ ID NO: 29417 - DNA, 411 bp, Homo sapiens
  misc_feature 4: n = A,T,C or G
aagnatggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttcccct

SEQ ID NO: 29418 - DNA, 332 bp, Homo sapiens
  misc_feature 31, 210: n = A,T,C or G
aaaaacaattattttaactgattgtttctanaagcttcggatctaaatagcacagtagtctaaattgcataggaagtatgcaaaaagtttgacaaataaactttaaaaatattttccggttaatatatctagttttaaaatttctgggtcatacattgctagttattctactttgataatgacagtattttagagtggaaaagctgtctnaacatgatttggtcaccttctttcctagataatatgtaaatagttacttttgaacattaattaataaaggacctacgttagagtagatgttaacaaagagaacttaaatagctctaaaaatg

SEQ ID NO: 29419 - DNA, 188 bp, Homo sapiens
  misc_feature 10, 16, 29, 40, 41, 44: n = A,T,C or G
tggcgcgggnagaacntcaagctttgagnaaaggctagcnnagnagcaaggaaagagagaaaacaacaaagtggcgaggccctcagagtgaaagcgtaaggttcagtcagcctgctgcagcttttgcagacctcagctgggcatctccagactcccctgaaggaagagccttcctcacccaaacccca

SEQ ID NO: 29420 - DNA, 237 bp, Homo sapiens
  misc_feature 15, 74, 215, 216: n = A,T,C or G
aggccgggggggacngtggggagagatgggcgaggtgcctttactacatgtgtgatctgaaaaccctgcttggntctgagctgcgtctattgaattggtaaagtaataccaatggctttttatcatttccttcttccctttaagtttcacttgaaattttaaaaatcatggttatttttatcgttgggatctttctgtcttctgggttccatttnntaaatgtttaaaaatatgttg

SEQ ID NO: 29421 - DNA, 489 bp, Homo sapiens
  misc_feature 2, 3: n = A,T,C or G
annaaatagtctgtttagagctgtgtttgcaggtacagctagaataagcaggaattagcatgcaaaaagacctgccctggccctgacttctttatcagcaccatccttcaggactggttttttccccactttggattgattgggcaggtgatttaccatccaagatgaagagttttaaaagaagaaaaagagacatcggaaattgctgtgcatgtgcaacagcatgcgtgcgagagaaagagagatacaaatcctgttgtgttatatctattgacagtttcataccaggcagagctggcaaaataaacttgagtggacgatcctagcaacttgagaattgattaaagcttccttgggctttcagcacagtgtccacatcaaaaaggcatgagaagcaaaataaatgattcttttgccatgatatgctgccgccagaatctctaagcctatctaattggcctgtgtcaattgtggactattaatttgaag

SEQ ID NO: 29422 - DNA, 161 bp, Homo sapiens
  misc_feature 3, 140: n = A,T,C or G
gcntcttagcggtggatcactcggctcgtgcgtcgatgaagaacgcagctagctgcgagaaattaatgtgaattgcaggacacattgatcatcgacacttcgaacgcacttgcgggccccgggttcctcccggggctacncctgtctgagcgtcgcttgcc

SEQ ID NO: 29423 - DNA, 346 bp, Homo sapiens
tgcaacaattgggaatgctgagcaaggctttgcccctatatccctatgcacttctgttggaagaatgttcaagcctcttcccaagacagctccagtgtttggggaaaataaagtgctctcccttggcctgggcccttggatcccaagtggaaaggtgagtcacggagggaggtgctcttcctctctcatgtactaggactttactcatttttgtagccagataccatcacaagggccgtttgctggcattctcattttttggatcaatggtgtccttcacaattctgtgaaggaaatttccattttccttcttgatttaaagttcacagagttggtctttatgcac

SEQ ID NO: 29424 - DNA, 114 bp, Homo sapiens
  misc_feature 2: n = A,T,C or G
antttggcttaggttcagtcctaacaaatattcccataaaaggtgaagttagaatcactggactggatgggttgtagacctgcaaaggatcaaaaacataatattcaatagatg

SEQ ID NO: 29425 - DNA, 359 bp, Homo sapiens
  misc_feature 30: n = A,T,C or G
gggtcctttgtctctcgctgcagccggagntaaaggccttgtccttactgttcctagagtcccagcctctgtggccctatgacctgcaggtattgggagatccacaactaagtcgccaggaccccctggaagcctagaaatgggagcattgacatttagggatgtggccatagaattctctctggaggagtggcaatgcctggattctacacagcagaatttatataggaatgtgatgttagagaactacagaaacctggtcttcctgggtattgctgcctttaagccagacctgatcatttttctggagcaaggaaaagagccctggaatatgaagagacatgagatggtggaagaac

SEQ ID NO: 29426 - DNA, 216 bp, Homo sapiens
  misc_feature 6, 13, 109, 163, 166, 203: n = A,T,C or G
agtganctcaggnagcgtttataattgaagtaattcctgataccccagcagaagctggtggtctcaaggaaaacgacgtcataatcagcatcaatggacagtccgtggnccccgccaatgatgtcagcgacgtcattaaaagggaaagcaccctgaacatggnggnccgcaggggtaatgaagatatcatgatcacagggatncccgaagaaattg

SEQ ID NO: 29427 - DNA, 360 bp, Homo sapiens
cattttaggttccttataaaatacttcctacaggagtctttagttttgaagttataaaaaaaaattatcagaggaaatatgactaatgtatatgcttggttgagctgcattttcttactgtttctatacttagtattttaacaggatgtgattgataggaatttaacattctaattctttaagacaatcatgaagttctgatagtttcttagaaatggaaattgtgtcattatattttgttgttttattgttgtgcattttaacaaaagaggtgacttcacatgtaccctaaaacttaaagtataataataacaaacaaaacaaaacacatgtaccctaaaacttaaagtataataatac

SEQ ID NO: 29428 - DNA, 488 bp, Homo sapiens
gatcctcagtgctctgctcatgtttaagaacaggacactgaggggctgtctccttgcggctctacactagagcggagtatgagtctgaggcgaagggagtcatggcaggacaagcgtgtagaaagtttttttccactctctgactgagtattggttggaaggagcgctgctaaaactgcaaccaaaggaggcattttgcttccagaaaaatctcaaggaaaagtattgcaagcaacagtagtcactgttggatcgggttctaaaggtaaggctggagagattcaaccagttagcgtgaaagttggagataaagttcttctcccagaatatggaggcaccaaagtagttctagatgacaaggattatttcctatttagagatggtgacattcttggaaagtacatagactgaaataagtcactattgaaatggcatcagtgtgaagctgcccattctactgaagttctgaaatctttcatcatgtaaat

SEQ ID NO: 29429 - DNA, 446 bp, Homo sapiens
  misc_feature 396: n = A,T,C or G
gggaagctgggggaagttaaatatgagccctgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctatttttcagttgtgtgtaagcaagtttttttttagtgtagganaaatacttttccattgtttaactgcaaaacaagatgttaaggtatgcttc

SEQ ID NO: 29430 - DNA, 256 bp, Homo sapiens
catattgaactaactaagatttgaattttgcatggaaagaagcatggctttctttctgtagaaaaaaatttattagggcagtattatgaacatctaatatgttagagccaggcatagtggctcgcacctgtagtcccaggtacttggaggctgaggttggaggatcccttgagcccaggagttcgaggctgcagtgattcgagctacgatttgggcctctgtactgcagcccaggcgagagttagaccctgtctct

SEQ ID NO: 29431 - DNA, 223 bp, Homo sapiens
  misc_feature 20, 24, 27, 37, 38: n = A,T,C or G
gattttgtcccgggtaactngggnttntggcggggannattttgaaatgcgctacaataaacaaattagagcacacatttgaaatacaggcttctttacataaactgagaggttatacaaaactcagtttcacaagggaacaatctatacctttctaaaagttaatatttcaagtctctaataggcagaatattttactctttaaaatcctgcctttctgacc

SEQ ID NO: 29432 - DNA, 128 bp, Homo sapiens
catggtgaccacgggtgacggggaatcagggttcgattccggagagggagcctgagaaacggctaccacatccaaggaaggcagcaggcgcgcaaattacccactcccgacccggggaggtagtgacg

SEQ ID NO: 29433 - DNA, 447 bp, Homo sapiens
gtccacccgtgatccacatccgcagcgagtacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcacttgaggccaggagctctgcccatgacctgtatcccacgtactccaacttccattcctcgccctgcccccggagcccgagtcctgtatcagcccttttatcctcacacgcttttctacaatggcattcaataaagtgcacgtgtttcttggtgc

SEQ ID NO: 29434 - DNA, 131 bp, Homo sapiens
  misc_feature 10: n = A,T,C or G
ggtgcggccnggagtaaagaaacgcgacttccacaaacctggattttttatgtacaaccctgaccctgaccgtttgctatattcctttttctatgaaataatgtgaatgataataaaacagctttgacttg

SEQ ID NO: 29435 - DNA, 261 bp, Homo sapiens
  misc_feature 19, 203, 233: n = A,T,C or G
agcaaaagttgaacaaagnagaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggnggatttacatattaaattttttctgctggnggataaacattaaaattaatcatgttcc

SEQ ID NO: 29436 - DNA, 201 bp, Homo sapiens
  misc_feature 3, 13, 97, 180, 192, 200: n = A,T,C or G
agnaaaaaaaaantcttttcccatttaaaataggctcagccagttcaatgtcgccttgttatcagagaaatattagttcaatactgaaagaaaaatnttatacctcttggtatctagaaaaacttgttcatccattataaatatatctttagccacagcaaaccacacttaacctatctntaataaaaatgngctttaant

SEQ ID NO: 29437 - DNA, 490 bp, Homo sapiens
gtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgat

SEQ ID NO: 29438 - DNA, 406 bp, Homo sapiens
  misc_feature 31: n = A,T,C or G
aagattcaagtagtatcttaaactacagagnaagattcgaatatactttcatttgatagtgatggtaatcaaaacatactttcaagtactttaactagtaaaggaaatgaaaccatagagtccatctttaaagctgaagatttgcttccagaagcagcttcactctctgaaaacctggatatcagtaaagaagagacccccccagttagaacacttaaatcacagtcatctttaagtggaaagcctaaggaacgttgcccacccaacctggctcctctctgtgtttcttataagaatatgaaaagaagctcttcacaaatgtcattggataccatttcacttgacagcatgatattggaagaacagttattagaaagtgatggaagtgatagccatatgtttttga

SEQ ID NO: 29439 - DNA, 242 bp, Homo sapiens
aggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaag

SEQ ID NO: 29440 - DNA, 310 bp, Homo sapiens
ggctcaagcctgtaatcccagcactttgggaggccgaggcgagtggatcacgaggtcaggagatcgagaccatcctggctaacacggtgaaaccccgtctgtactaaaagtacaaaaaaattagccggacgtggtggcgggcgcctgtagtcccagctactcgggaggctgaggcaggagaatggcgtgaacccgggaggcggagcttgcagtgagtcgagatggcgccactgcactccagcctgggcgacagagcgagactctgtctcaaaataaaataaaataaaataaaaaataaaacaaataaaga

SEQ ID NO: 29441 - DNA, 472 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaagatttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtg

SEQ ID NO: 29442 - DNA, 466 bp, Homo sapiens
caagacagattttcggaacacatttccctaccctaaagcgacatcccagtagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggccattggctactgactgtatttcccttgctcagtacatttttgttttccttttaccattttatcttgctttggaggaccttaaatgctactgaaacttacctgagaaccataggactgtggcaaacaaaaccaattcatgaagtgaattaatgatgaggatctgaaaacttggctggggctatatatcctggaagttgaaggttaaaggaaaagcacaagaaactttggaagcactttttctgcatacttagatgatcttcatg

SEQ ID NO: 29443 - DNA, 209 bp, Homo sapiens
  misc_feature 9, 95: n = A,T,C or G
ggagctgcnaacataacattcacccttttgaacagatggagtcaggcaccacctaacacagccttctgtcctcaataacacagccattattgccncttgctcagtcgtcagtgtaaacccctcagagtcagctgaactattttaggccaaacatactgtttttgtaaagtatttttcattaataaatctataagacagttctatctaag

SEQ ID NO: 29444 - DNA, 227 bp, Homo sapiens
  misc_feature 6: n = A,T,C or G
caaggnacctgcggagtgtctgctctatccccttccccctcagcggatgataatctcaagacacctccgagtgtctgctcactccccttccaccctcagctccaccctcagtggatgataatctcaagacacctcccaagtgtgtccgctcactccccttccaccctcagtggatgataatctgaagaaactaacgaagaataaataaataatataaaaataaaacg

SEQ ID NO: 29445 - DNA, 191 bp, Homo sapiens
attgttaattcaacatagggtgaaactatttctgataaagaacttttgaaaaactttttatactctaaagtgatactcagaacaaaagaaagtcataaaactcctgaatttaatttccccacctaagtcgagacagtattatcaaaacacatgtgcacacagattattttttggctccaaaactggattgc

SEQ ID NO: 29446 - DNA, 470 bp, Homo sapiens
gggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatat

SEQ ID NO: 29447 - DNA, 488 bp, Homo sapiens
  misc_feature 2: n = A,T,C or G
ancccaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatg

SEQ ID NO: 29448 - DNA, 482 bp, Homo sapiens
gaagtgtttccggtggattcccagggactgtcggaggtgtggactctgcctgcctacctggtctgggaagatgttctaccatatctccctagagcgcgaaatcctgctgcacccgcgctacttcggccccaacttgctcaacacggtgaagcagaagctcttcaccgaggtggaggggacctgcacagggaagtatggctttgtaattgctgtcaccaccattgacaatattggtgctggtgtgatccagccaggccgaggctttgtcctttatccagttaagtacaaggccattgttttccggccatttaaaggggaggtcgtggatgcttgttgtcactcaggtcaacaaggttggactcttcacagaaattgggcccatgtcttgcttcatctctcgacattccatcccttcagagatgggagtttgatcctaactccaacccaccatgttacaagacaatggatgaggatattggtga

SEQ ID NO: 29449 - DNA, 449 bp, Homo sapiens
  misc_feature 27, 29: n = A,T,C or G
gaacctcggtggtggccctgcgtagancnagacttcgctcgtactcgtgcgcctcgcttcgcttttcctccgcaacccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggagggaaggaaagaacttgcatgttggtgaaggaagaagt

SEQ ID NO: 29450 - DNA, 393 bp, Homo sapiens
  misc_feature 391: n = A,T,C or G
cagtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaantg

SEQ ID NO: 29451 - DNA, 105 bp, Homo sapiens
  misc_feature 8: n = A,T,C or G
attcttcnccatggccaacaacgaaggacttttctccctggtggcgaggaagctgagcagacccctgtgatgcctgtgacctcaattaaagcaattcctttgacc

SEQ ID NO: 29452 - DNA, 464 bp, Homo sapiens
tcagcattgttgtgaggatggaacaatattgttgattgtaatgccattagtaataataagcttacctacatgatcgtctatgtcacatccctatcagattaagaactcctgtgattgtttttggcctgtgcccttgtgtgagaccaactccaagttcatggacatgtgggtgtcctgagtgttcctggtggcctaatgttttagggaaaacagtggcctagaagttttaggcaatgttactggtggtctagaacttttagggaaaacagtaattgctcctcagaaggtcaattttaggctggctttgaattcatcagctaatcacacaagattccattttttgcttaaataaacagatgtaactagtgacccatgttcttaaaaaatttgttcagatactaattaaattccttccttttgctcgtagctatgctcctgtttaggtatgcagacctgacttcttg

SEQ ID NO: 29453 - DNA, 279 bp, Homo sapiens
aggcacagtggttcacgcctgtaatcccagcactatgggaggctgaggcaggcggatcagctgaggtcaggagttcgagaccagcctgaccaacatggtgaaaccctgtctctactaaaaatacagaattagccgggcgtggtggtgcatgcctgtaatcccagctacttgggtggctgaggcagaagaatcgcttgactctgggaggtagaggttgcagtgagccaaaatcgtgccattgtactccagcgggggcaacaggagcgaaactccatcaca

SEQ ID NO: 29454 - DNA, 470 bp, Homo sapiens
cattggaaatgtctgtttagctttataaaacaaacactttgctgaaataggaaaatgagccttattgacaattaagtgcttcttgcagcaggtggtcaaagaaaagcatgactaatacgacctattagagtaatctacatctggaccattccttaagtttttcctcaccgacagtaccatcatgccttgagtgttcttttctcccaagtgctattccttaaacacgagagtttaccagttgcctaataatgcaataaaaaatgctttgagatagctaactgcccataaaacaaactcaaattgcttataaagtttcttcccatgttcccatttgatgaaaagtcttacatcacatataactgggaagcaggggtccctcctcaattttcagacattttgaaaggatgacagttctgtttgttagatgagtaaacctctatattcataagttctaaaatccttcattatga

SEQ ID NO: 29455 - DNA, 162 bp, Homo sapiens
gttgatagaaatggatttattaatataatggatggtccaaagaaaggtgaatgaaagagtcataaaagatgttgaggtagttctctattgatgccagaatagccctatggtgcacttttgagtaacagaagccaatttgttaaaaacaacaacaacaacagt

SEQ ID NO: 29456 - DNA, 233 bp, Homo sapiens
  misc_feature 3, 14, 56, 61, 62, 63, 64, 67, 77, 78, 83, 112, 184, 186,220: n = A,T,C or G
canggaacctcggntattatggcccgggaatcacacaggactctaagccaaactcntgttnnnnctnctttatttcnnaacanaagtgtctccttgcacttatccttggcanacccttgactccaggggagatgacctgggggaggaagtgtgtcaactatttctttaggcctgtttggctccnangcctatatgtgcctggatcctctgccacgggttnaattttcaggtga

SEQ ID NO: 29457 - DNA, 127 bp, Homo sapiens
gttgtcaaagtttgttttttctaaagttgtgtgattatatatttgacattttacatttcaaagaaaggtatgttgtctaacaggggaccaacagaaggtagtattgacaactgttcccgcttctacc

SEQ ID NO: 29458 - DNA, 189 bp, Homo sapiens
aactgcggggtagtagcgatctgggttacccagccgttgtggcccttgagggtgccacgaagggtcatctgctcagtcatggcggcggcgagagcgtgtgtcgctgcagcgacgaggatggcactggatggcttagagaaactagcaccacaacctctcctgccgccgccttgcagtgaaagagagaga

SEQ ID NO: 29459 - DNA, 118 bp, Homo sapiens
  misc_feature 118: n = A,T,C or G
gagaggctgggaatggaggggcagagccaggaagatcccccagtaaaagaaagctacagaagaaactggggctcctccagggtggcagcaacaataaatagacacgcacggcagcccn

SEQ ID NO: 29460 - DNA, 463 bp, Homo sapiens
  misc_feature 12, 17: n = A,T,C or G
ggaaggcccagnaccgnagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagag

SEQ ID NO: 29461 - DNA, 315 bp, Homo sapiens
  misc_feature 105, 280, 285, 287: n = A,T,C or G
attttagatgggcacaatattttagtatggactgaggacccagagtactgaccttgaaggggactcagaagaagatccttgacattgccaacatgctgggcttgnccaacacagtgatgcggctcatcagagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgngaaananagaggggggcccagaggccgccttttga

SEQ ID NO: 29462 - DNA, 471 bp, Homo sapiens
ggggtggaaacgcgctggctgactggggtcggcgtttagttcagcgcagcgactcggggacctggagctgacgcctagttgctatggtgacagactatggggcctttatcaaaatcccaggctgtcggaagcaaggtctggtccatcgaacctcatatgtcatcctgtccgggtgggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtggga

SEQ ID NO: 29463 - DNA, 176 bp, Homo sapiens
gaaggagaggggtcagggttgattcgggaggatcctattggtgcgggggctttgtatgattatgggcgttgattagtagtagttactggttgaacattgtttgttggtgtatatattgtaattgagattgctcgggggaataggttatgtgattaggagtagggttaggatgagtg

SEQ ID NO: 29464 - DNA, 426 bp, Homo sapiens
gacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaaaggcccggctgcgtagcagttgagtgatgctggttagctattaaggtggcctg

SEQ ID NO: 29465 - DNA, 281 bp, Homo sapiens
  misc_feature 18, 23: n = A,T,C or G
taagacaaagaacatatnaaatnaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtag

SEQ ID NO: 29466 - DNA, 441 bp, Homo sapiens
  misc_feature 16, 39, 102, 116, 158, 169, 238, 297: n = A,T,C or G
ataaacagggagtgtnaactgcccccaaatgttcctggnctgggtcaaagcagctggagtgaagcactcattttccataaaggtaacaaagggcagctcagnggttactcaagctnaaaagggtttttttaagagcaagcattggctaagtctgtgtntactgagttgnaagtgatttcagcacattcttttttagtggagtgaaagttctgaagcccccttttaacttcctcttggnttttcattataattggtagccatctcatgaactgtctctgactgttgactctttgtggncatgtgattgtgagcttgctttctgacttgcatttctgactttatcctgttgttaggaagatagaaactaggttttgaaagattacatgattcaagcgagggattttaaagtaaagatgtatttattctgaagaatctaaaaga

SEQ ID NO: 29467 - DNA, 463 bp, Homo sapiens
  misc_feature 336: n = A,T,C or G
gatgaaataatgaaatgaaaatgaaatggaaatgatgagatgagaagaaatgatgagatgaaatgatgaaatgatgagatgagataaaatgagatgaaatgagatgagatgaaatgacctaatgaatgaaatgatgaaatggaataatgaaatggaaatgatgagctgagatgcaatgagttgaaatgagatgaaatgatgaaatgatgagatgaaatgatgagatgtgatgaaatgatgacatgaaatgatgacataaaatgagatgaaatgagatgtaatgatggaatgagatgagatgaaatgagatgaaatgatagatgagataaaatgatntgaaatgatgagatgaatgatgagatgatgagatgaatgatgaaatgaaatgatgagatgagatgatgaaatgaaatggtgagatgaaatgatgagatgaaatgaaatagtgaaatgaaattgaaat

SEQ ID NO: 29468 - DNA, 472 bp, Homo sapiens
  misc_feature 19, 382: n = A,T,C or G
tgtcctagcagttgtggtntcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggnctgggatgtctccatctctgtctcaactttacgtgcactgagctgcaacttcttacttccctactgaaaataagaatctgaatataaatt

SEQ ID NO: 29469 - DNA, 472 bp, Homo sapiens
aggtactattggttttttacaacgccggcgtttgtgtatgtagtaaaagtattaacagcattaaaggcgatatttttaacatgtttatagatactacttgggggagggcagctaatgaaaccttcaagctctatgcagtccacagacgtgagctctgtagagttcgcagaggtgggtaagtacccagccagcacacccagttgaattcagccaggatttattgagttggcatcacggacgctgacagcctccaagtgaaaacccttctcttgaatatgtacaggtttcccatccacataccaagctgatgaggatcccatcgttcttccccagtcctgaggagcccccctcgccatctgcaccttccatagccaaatcagggtcattggactcagaactttcagtgtccccaaaaagggaacagcatctctcggacacacaaagataaggggccttttcacatactgagttc

SEQ ID NO: 29470 - DNA, 360 bp, Homo sapiens
gttattttagagagtcatccttctttaaaaaaaagcccgttgtaaaacagcttcaggcagggccttcaggaggtttccagaagatggcagctccatgtgtgctgtcacctctgaagcccttccagtgggacagaggtgctggtggaagacagtgatgttgatgatcctgaccctgtgtaggtctaggctaatgtgtgtgtgtgtgtgtcttagtttttcccaacaatgtttacaaagtaaaaaaccataatttaaaaatggaaaaaagtttataggataaggatagaaaggaaatatttttgtacagttgtccaatgtgtgtgtgtttaagccaagtgttattatgagtcaaaaagttga

SEQ ID NO: 29471 - DNA, 119 bp, Homo sapiens
cgcagtggctcaagcctgtaatcccagcactttgggaggctgaggcgggcagatcacgaggtcaggagatcgagaccatcctggccaacatggtgaaaccctgtctctactaaaaatat

SEQ ID NO: 29472 - DNA, 466 bp, Homo sapiens
  misc_feature 3, 51, 58, 105, 118, 182, 184, 189, 229, 348: n = A,T,C or G
gtncattaaatgttttaaatctataaaaccttatgtgaaactttgaaaatnatatgcntctacagaatctgaatataattttatccaatttgttaaaaggctgtnaaaagtttagagnaaaatgttaaagatcttgttttttatcattgttttctttttggcgctctttcctgtcacattgngnttttncgggcaaaatcagtggccaaataatgaaacccactggtgncttttgagcagtagcatatgttggaatgatcatagccccatgtacataacaaggcctcagtaaagttttattgaacaaataaatgaaaactcatatatattagagtctacagtatttgntcaattgctaattattttactatattctcttttcttcttttctgcagcaaattagaatagcatttgtatttgttaaaagtttagattgcatattaattaggaaaacagttgaatttcg

SEQ ID NO: 29473 - DNA, 470 bp, Homo sapiens
acatgcagattaatgttaaacatattgataatctaagctaaagttagagcaaataattgtgatttattcatgtccataactaaaatattattctttagcactcatttcagttaatatcaagctttgttcacactgatatattgattgggattcttcaaacgaagaatgaaacattattgacttatttctaagtgtaataactcaataactaaattgagaattttcttgttttttgtgtacaattaaattattccattttatatatacttattaagttataagcatgttaataaggagacttttgactgtccagcctaatggaggatctgattcccattaaggatgtgggaattcccgtattttcctcttcaggtttttttgtttttaagtctacagagagatagaaccttaacattgcccagtttgataaaagtgaaaatttgctcacctatacaaatgttattttacac

SEQ ID NO: 29474 - DNA, 119 bp, Homo sapiens
cggtgggatgattttaacatgcaaaatgtccctgggggtttcttctttgcttgctttcttcctccgtaccctaccccccactcacacactcacacacacacacacacacacacacacac

SEQ ID NO: 29475 - DNA, 305 bp, Homo sapiens
agtggtcagggtaggaaggcggtggaggatcaagtagaacaaaattgaggatcaccagagttcaacatttagttcacatcaacaaatgaatggagtttctcaccatggacaaggtactgtttgagcatggtaggacttagagctgagtaagataccacttctgacttctgacagctcgcacagttatatactcagtgaacgctgaggtgcaatgaatgaggttcagtaagagtatataagaaaatgctgtaagaataaagaggaagacatgatttatatgactggtgtttttatgcaagatctga

SEQ ID NO: 29476 - DNA, 456 bp, Homo sapiens; identical to SEQ ID NO: 28954

SEQ ID NO: 29477 - DNA, 360 bp, Homo sapiens
gagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatg

SEQ ID NO: 29478 - DNA, 369 bp, Homo sapiens
gaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagcctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcctaaaaaac

SEQ ID NO: 29479 - DNA, 358 bp, Homo sapiens
  misc_feature 23: n = A,T,C or G
aataaaaagaaattttgcctgcnttttcagaatcatcttttgaagctttctgttgatgttaactgagctactagagatattcttatttcactaaatgtaaaatttggagtaaatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattc

SEQ ID NO: 29480 - DNA, 476 bp, Homo sapiens
gacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccat

SEQ ID NO: 29481 - DNA, 467 bp, Homo sapiens
  misc_feature 109, 265, 274, 323, 328: n = A,T,C or G
gaggcattgaggcagccagcgcaggggcttctgctgagggggcaggcggagcttgaggaaaccgcagataagtttttttctctttgaaagatagagattaatacaactncttaaaaaatatagtcaataggttactaagatattgcttagcgttaagtttttaacgtaattttaatagcttaagattttaagagaaaatatgaagacttagaagagtaccatgaggaaggaaaagataaaaggtttctaaaacatgacggaggtngagatgaancttcttcatggagtaaaaaatgtatttaaaagaaaattgagagaaaggnctacngagccctgaattcataccaatagaagggcaatgctttttagattaaaatgaaggtgacttaaacagcttaaagtttagtttaaaagttgtaggtgattaaaataatttgaaggcgatcttttaaaaagagattaaaccg

SEQ ID NO: 29482 - DNA, 472 bp, Homo sapiens
  misc_feature 4: n = A,T,C or G
gctnaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgta

SEQ ID NO: 29483 - DNA, 472 bp, Homo sapiens
aggaggtggaggtgggagaagagtggaaactgacttcacatttctccagggagggatgctttggaaaaactgctcagtgagatgaagcacagatctgcttttcatcccttttgtacctttttaaagacataaggtatgttttgacactggagtatatatgagggttgctaacgtttgggttgaaagagctgctgttgtccacagcttatttattttccacccatttttgtctcctggtctcatccagttacatttcctgggatatgtttttggaggttgctcagatcacggcactagagtccctttgggtttctcctccctcctctgtctatttggcctcgcccttgacaaacattccccacattcacacccaggcctttggcctaatgttcttgaatgttgcttgcctctcattgaataggcttttatgtagctctcatattcagttcatattttggcattttaaaaaata

SEQ ID NO: 29484 - DNA, 431 bp, Homo sapiens
  misc_feature 5, 17: n = A,T,C or G
acccngggaattcggcnttatggccgagcaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccagcttgccttcatgcgcctgctggccgactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgct

SEQ ID NO: 29485 - DNA, 470 bp, Homo sapiens
  misc_feature 418: n = A,T,C or G
ggctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcnaaactacttagacatcaaaggtttgcttgatgttacatgcaagactgttgcc

SEQ ID NO: 29486 - DNA, 467 bp, Homo sapiens
gctttcaacataaataacagttatgagtgtatcaaaaacttataatcaaatgtgatataaagaagatatactctatagtcatcatatatatatgtatcttaaattcatatcattatatattctgtctttataatttgaatcattgccaaaatactgttgagttatattacttacttaaaatggataatattctaattttttccttaaattgtaggttatatttattaaatcatatttttaacatcttctgatcaggtccctaataattttattttataaaaaaagtatttcaaagatggtatttaatagatcatcattatgttgatcttgtcattaaatcttctaaagcatcatcaagttctcctagtccaactgcttatttacagatgagaaaactaagcctaatactatgcccaaagtgaaatatgcttatgctttggaattgagaatagaaccttggcttcttc

SEQ ID NO: 29487 - DNA, 472 bp, Homo sapiens
gagttaaaacattcgaatgttttgagtccctttacttaaagaacttaagatgcagaagagacatcagtagatgatccagcaatgatctataatgaggcagaacaaagacttgaatggttcctcgaactcctgctccagtgctctacccacttgcctatatttgttatgctacttggatcaaatgttgaaacctgtcaatgttaaactttctggtcactatatgttcaatagaagaagcctgagtcttggcatcatttgtcaacttacttcatgaaattaaaaggttgataatataaattaatgacataatattattcatcttaacctgactcaactgtctgaacaattttgcttatcatgatgccctattcatgaaatttaatcaaagtgatgtgctgcctcaatttaaggaaatgtttagaagataaatgtaatttttattttcttaagcagaagagtaaaagcatcaaac

SEQ ID NO: 29488 - DNA, 269 bp, Homo sapiens
  misc_feature 25, 35, 36, 38, 48, 57, 58, 72, 147: n = A,T,C or G
gggtgacatggtgatggccacagtncagaaaggcnnancagagctcanaaaaaaggnncatccagcagtggncattcgacaacgaaagtcataccgtataaaagatggcgtgtttctttattttgaagataatgcaggagtcatagngaacaataaaggcgagatgaaaggttctgccattacaggaccagtagcaaaggagtgtgcagacttgtggccccggattgcatccaatgctggcagcattgcatgattctccagtatatttg

SEQ ID NO: 29489 - DNA, 472 bp, Homo sapiens
tgagatttgataaataagtcccattgtcctaatccgctagtgatgatgttctagcctttgaaattcaaactactactactccactttgagagagactgcatgagaattggacccagcctggggctttagacaccatggttcaaatcttggctcttatcattttttagccacgtgtcatggactcaatgtttttgtctcccagctccccagattcacaggttgaagccctaacctccaatgtggctgaatttgagattagggcctgtgaggagctggtaaaagttaaatgaattcttaaggataggtctccaatcctatagagttggtgctcttacaagaagagggacagacacccgagttctctctctttgctatatgaggacatggtgaggagtggccatctgcaagctcagaagagagccctcaccaggaacttaagtgtctggcaccttgatcgtggacttcccgacct

SEQ ID NO: 29490 - DNA, 472 bp, Homo sapiens
  misc_feature 457: n = A,T,C or G
aagagaacacatccaaaatgcatgattcttacaaactaaaggaagttaatgtgcaaaaatctcaaccaaaactactatttttagtatacttgtttacgtaaatgctgattggaaatatttaaatgactatagatctgattctttcttttcctttggaaactgggattaatgtatgctctagatccatttattagaaatgcaaaaatactacaattttttgatggatgaaaatactcctgtaacacaaacagagaactggaggaactgaagaataactcactcatatagctctgcctcattctgtgtgtgtgtgcatgtgtgtgttagcagaggtattttactcagaaaataggtttcaaagaacattaatgactttcttttcccttttatgtctgcttaatcagtgtaaacctggctatgggaaaaagttttatagaactatataacctgaatggtnggtctctttgtacac

SEQ ID NO: 29491 - DNA, 424 bp, Homo sapiens
ctcgcgtgatgggaaggctctggagaggttcctgcaggattactttgatggcaatctgaagagatacctgaagtctgaacccttattcccagagagcaatgatgggcctgtgaaggtagtggtagcagagaattttgatgaaatagtgaataatgaaaataaagatgtgctgattgaattttatgccccttggtgtggtcacttgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaag

SEQ ID NO: 29492 - DNA, 192 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttagg

SEQ ID NO: 29493 - DNA, 118 bp, Homo sapiens
  misc_feature 7: n = A,T,C or G
cgcaggnactgtgtgtgtcctacacaatggtgctattctgtgtcaaacacctctgtattttttaaaacatcaattgatattaaaaatgaaaagattattggaaagttaaaaaaaaaag

SEQ ID NO: 29494 - DNA, 498 bp, Homo sapiens
  misc_feature 9, 24, 27, 32, 36, 40, 44, 49, 314, 370, 385: n = A,T,C or G
tctccgggnaagcgcgccctttgntgnggggngcgngcangtgntgctnttttgccccttcttcttcagattccatccaaatgcccttgtgcagaattcagacaaatctgtgacagcagggcatagtgaaaacagcataagctttgaggtcagaaagacctggaccaaatgccagctttgaaagccacttaaaagccctgcggccctaaacataacagctacacttacgtagcacttaaaacacgccacgtactattctatgtgccctacacatgttaacttacttaattctcaccactaactcatgaggttgngtactattagcatcctattttatagatgggggtgttcaggtatggaaaggtcaagnaacttgcatctaggnaagctgcagaacgaagatgtgaatttacacagtctggctccaaagtcagtgtctaagccacgcacggtggctcatgcctatcattccagcactttgggaggccaaggtgggag

SEQ ID NO: 29495 - DNA, 101 bp, Homo sapiens
  misc_feature 32, 33, 66, 92: n = A,T,C or G
cgcgtgggggcggccggaggaaggggaagctnnatggactaggagagacttgattttggtgctaangttccccagttcatatgtgacatctntttaaaaaa

SEQ ID NO: 29496 - DNA, 234 bp, Homo sapiens
agtggtgaaatatagtgattttcacctgtgcttccattctgaagttctggaaagaagtactggatggactgaagtccaggacaacgttccaaagaaaggcagagtccaggtaggcttggaggaccaagccctggatgagcactggagggcagaggcctcagtgtccagcactgtgccctgcacatggaaagcccctacgtttgtggaatgaatgaataataaaaatgttttcat

SEQ ID NO: 29497 - DNA, 307 bp, Homo sapiens
  misc_feature 5, 13, 19, 28, 63, 117, 121, 180, 184, 250, 253, 288, 305: n = A,T,C or G
acgangttttccnctgggnctagatganaaacagctgggtatttggctagagaaaccgctggnaaaactcacgttggctaacaacacttctcccagaccttcacatggtgatagcangttnatctcagctctaatgccacctcctcagagactctttctctgacactcaaccccatgccntctncttaaacatatcaccctcttcctttagggcacttatcacaatcgggaatgatcttatttatttgtnaanaggtctctcttctcacaaaacataagcaggatganagcagagcccttgtctngc

SEQ ID NO: 29498 - DNA, 290 bp, Homo sapiens
ggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtga

SEQ ID NO: 29499 - DNA, 115 bp, Homo sapiens
gagaaagacatttgagaaaaagccaactgctacaggaactttcggcgtccgactagatgactgcccaccagctcatactaatcggtatattccattaatagttgacatatgttgc

SEQ ID NO: 29500 - DNA, 105 bp, Homo sapiens
  misc_feature 35, 56, 69: n = A,T,C or G
gaaactggtacaggcaacatgttggcttttttgtnaatcagttttttttttttganaaattttgctttngggaaaaatctgccttttcaaagttttctttccttc

SEQ ID NO: 29501 - DNA, 123 bp, Homo sapiens
ggttttcttttgcctgacaacttctaattgccatgtacagtatgttcaaagtcaaataactcctcattgtaaacaaactgtgtaactgcccaaagcagcacttataaatcagcctaacataag

SEQ ID NO: 29502 - DNA, 470 bp, Homo sapiens
gtccatttagaagaagaaccaaacacatctgatctgctcttaaaggaaactcaattgtgacaagcagaggaaactaaagaggtaagagtatttccttgctagtggtagaattggctctagaaccagaaaggttaaattataaatctttggcaaaacacagctttctttacgtcattttcctctgggactagatgagaaacagctgggtatttggctagagaaaccgctggaaaaactcacgttggttaacaacacttctcccagaccttcacatggtgattgcagttcatctcagctctaatgccacctcctcagagtctctttctctgacactcaaccccatgccctcttcttaaacatatcaccctcttcctttagggcacttatcacaatcgggaatgatcttatttatttgttaatagtctctcttctcacaaaacataagcaggatgagagcagagcccttgtct

SEQ ID NO: 29503 - DNA, 471 bp, Homo sapiens
  misc_feature 22, 37, 49, 55, 60, 107, 137, 143, 385: n = A,T,C or G
gatatattggtggattcttgtncatagtgctctgctntaagaattaacnaaagcngtgtnaagacagtaaggattcaaaccatttgccaaaaatgagtctaagtgcntttactctcttcctggcattgattggtggnaccagnggccagtactatgattatgattttcccctatcaatttatgggcaatcatcaccaaactgtgcaccaggaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctanatcacaaccttctagaaaactccaagataaaagggagagttttctctaaattgaaacaactgaagaagctgcatataaaccacaac

SEQ ID NO: 29504 - DNA, 152 bp, Homo sapiens
  misc_feature 66: n = A,T,C or G
ggatttagtctgaggcgaagcttcggagcggccggtactgttgaaagcgacaagtggaggcgccgntctagcggccgggactctgaactatggcggctagtgatacagagcgagatggactagccccagaaaagacatcaccagatagagat

SEQ ID NO: 29505 - DNA, 440 bp, Homo sapiens
catagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagcttgggtgtccctgcacgcccaccccatgaaactcgagcaggtctctggaagccatttgtt

SEQ ID NO: 29506 - DNA, 401 bp, Homo sapiens
  misc_feature 159: n = A,T,C or G
aaaggaccaagtactttcaatctcagtcactctaggactctgcactgaatggctgacctgacctgatgtccattcatcccaccctctcacagttcggacttttctcccctctctttctaagagacctgaactgggcagactgcaaaataaaatctcggngttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaggattatttgggaaaga

SEQ ID NO: 29507 - DNA, 216 bp, Homo sapiens
  misc_feature 30, 32: n = A,T,C or G
agttccggaaacaaccctgtactttcagcntntattaataatctgagaatgccagtgtcacaaaagatcacagaaaacaaaattgtggatgcgggggtactaaggtaacaaaactgtcatcttggttgttcctaaggtttcctgcattttagaaaattagagttaattataacaaaacaaagcactgagtgataacataaaggtcttatacattac

SEQ ID NO: 29508 - DNA, 353 bp, Homo sapiens
agggccgcctgtgatgactacagactttgtgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttca

SEQ ID NO: 29509 - DNA, 108 bp, Homo sapiens
  misc_feature 6: n = A,T,C or G
ggggantcagggttcgattccggagagggtgcctgagaaacggctaccacatccaaggaaggcagcaggcgcgcaaattacccactcccgacccggggaggtagtgat

SEQ ID NO: 29510 - DNA, 474 bp, Homo sapiens
  misc_feature 1, 11, 24, 26: n = A,T,C or G
ncttcacaagnaggcgccgaagcntntaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatc

SEQ ID NO: 29511 - DNA, 288 bp, Homo sapiens
  misc_feature 7: n = A,T,C or G
gaaggcnttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggag

SEQ ID NO: 29512 - DNA, 335 bp, Homo sapiens
  misc_feature 333: n = A,T,C or G
gatgcaagcaacagccctagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaanac

SEQ ID NO: 29513 - DNA, 346 bp, Homo sapiens
  misc_feature 5: n = A,T,C or G
agggnagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgat

SEQ ID NO: 29514 - DNA, 135 bp, Homo sapiens
  misc_feature 133: n = A,T,C or G
aaacagcaaaaaactaccgaatccaaaataacagtctacaaccacacaagtaacatctaccacaactcaagataccacaccattcaaaattactactcttaaaacaactactcttgcacccaaagtaactacnat

SEQ ID NO: 29515 - DNA, 497 bp, Homo sapiens
  misc_feature 5: n = A,T,C or G
caggnaccctcgttttttatggccgaggggaacgagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaat

SEQ ID NO: 29516 - DNA, 391 bp, Homo sapiens
  misc_feature 8: n = A,T,C or G
ggaagcangcatgtggagaaataggaacgcttttacactgttggtgggactgtaaactagttcaaccattgtagaagacagtgtggtgattcctcaaggatctagaactagaaataccatttgatccagccatccccttactgggtatatacccaaaggactataagtcatgctgctataaagacacatgcacacgtatgtttattgcagcactattcacgatagcaaagacttggaaccaacccaaatgtccatcaatgatagactggattaagaaaatgtggcacatacacaccatggaatactatgcagccataaaaaaaggatgagttcacgtcctttgtagggacatggatgaagctggaaaccatcattctcagcaaactatagc

SEQ ID NO: 29517 - DNA, 279 bp, Homo sapiens
  misc_feature 7, 33: n = A,T,C or G
agaagtncatcaatgaaatgagtatttaaaatnaaaatttgccttaatgtatcagttcagctcacaagtattttaagatgattgagaagacttgaattaaagaaaaaaaaaattctcaatcatatttttaaaatataagactaaaattgtttttaaaacacatttcaaatagaagtgagtttgaactgaccttatttatactctttttaagtttgttccttttccctgtgcctgtgtcaaatcttcaagtcttgctgaaaatacatttgatacaaagtt

SEQ ID NO: 29518 - DNA, 471 bp, Homo sapiens
  misc_feature 31: n = A,T,C or G
aagttcggattgagtttcaacagcatctctnctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaag

SEQ ID NO: 29519 - DNA, 196 bp, Homo sapiens
attgcaattaggttggcattaatctgaacctactttatgttaagatattaatcatagtccctagggcaacctctaggaaaaaaaactcaaaaaatacaataagaggaacaagaaggaaatcaaaatgatatactagaaaatacctatttaatacaaaaggcagtagtggagaaattaaatcaaaagacataagatg

SEQ ID NO: 29520 - DNA, 471 bp, Homo sapiens
  misc_feature 8, 20: n = A,T,C or G
caatgccntccccatcaagnctaccagtgactttcttcacagaattggaaaaaactactttaaagttcatatggaaccaaaaaagagcccacattgccaagtcaatcctaagcctaaagaacaaagctgggggcgtcacactacctgccttcaaactatacttacaaggctacagtaaccaaaacagcatggtactggtaccaaaacagagatatagaccaatggaacagaatagagccctcagaaataatgccacatatctacaactatctgatctttgacaaacctgacaaaaacaagaaatagggaaaggattccctatttaataaatggtgctgggaaaactggctagccatatgtagaaagctgaaactggatcccttccttacaccttatacaaaaattaattcaagatggattaaagacttaaatgttagacctaaaaccataaaaatgctagaagaaaaccta

SEQ ID NO: 29521 - DNA, 203 bp, Homo sapiens
  misc_feature 13, 16, 41: n = A,T,C or G
tatggccgggggnatntttgtacatgtatggtgtacatgtntggtggcctcttgtgtctttaactggcttgagaattggatcatattttctttaaggcaacatctctaatacagttggccctctgaatctgtgagttccacatttataaatgcaaccaactgcaagttgaaaatattaagggggaaaaaattaacttagctcc

SEQ ID NO: 29522 - DNA, 410 bp, Homo sapiens
gaattaagtagatgtataaacggcagattatgaaagggaaacaaagattacctgggaagagttttgtgttttagtcaactgaattaccagaatgggcagaaaaaggaagtatcaaagaagggtctgctgatagaaaattaaataaagaagaagatgccatggaaacgtttttagtgcaaatacactattgctcatggctgaagacagaaagaagactatgtgtgacttccagatgaagttcaggcatagaggcagggctaaataaacaagcacatagacccgagaattctcgttgattgatctttggaaattcggtataaatatgatcagttcaaccatgccttagctactggatcaaaggagacatctaccggctttgggagataggaatctggaaaattgacagactg

SEQ ID NO: 29523 - DNA, 360 bp, Homo sapiens
  misc_feature 6: n = A,T,C or G
taatgnaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcaggggaaggtaaccctgaagcaggactttgtaaagc

SEQ ID NO: 29524 - DNA, 198 bp, Homo sapiens
  misc_feature 6: n = A,T,C or G
ataggnatatgtaaataatgtacatctgttgatttctggagtgtctgttatccaatgatgtatatactcccacagctcgcatgaaggaacagcctctattgatacttggttgtaaagtgaagtaagattggagggtggatggctgtcagagctcttgcagatactgtgttcacctaaataaaaatcacgtgtattgtt

SEQ ID NO: 29525 - DNA, 498 bp, Homo sapiens
  misc_feature 3, 13, 27, 30, 34, 36, 43, 51, 52, 56, 61, 63, 64, 71, 83,84, 86, 95, 109: n = A,T,C or G
gangaactctatntattgataacactngcntttntnatgcctnaaacaagnntctnactgngnncgctgtngactgaacaccnnancgatgcttnctgagtacctattnactgaacacctctgtgacagctctgagctgattactgtaaatataggaattctcctagcagatacagtcactgccgtcatagagcttttaaactagtaaagaagataaatattaggcttgtaagtttgataattattacaaaggaaatgtacagtacattttaaagacatgttactagatccatgaaaaaaatgacagattcaggacctagcaataaatcagcacaatttttcaagcaggcaatagaaataatgtgcttgccccctgaagccctaacaatgattagcatctgccacctgagcaaggtgcctgatgccaacatgaagtcctatgtgtcagggtggctccagctacaataaagaaaccctcctactcagctggctcaaata

SEQ ID NO: 29526 - DNA, 317 bp, Homo sapiens
  misc_feature 31, 63, 129, 285: n = A,T,C or G
acatgctaagacttcaccagtcaaagcgatntactatactcaattgatccaataacttgaccnacggaacaagttaccctagggataacagcgcaatcctattctagagtccatatcaacaatagggtntacgacctcgatgttggatcaggacatcccgatggtgcagccgctattaaaggttcgtttgttcaacgattaaagtcctgcgtgatctgagttcagaccggagtaatccaggtcggtttctatctacttcaaattcctccctgtacgaaaggacangagaaataaggcctacttcacaaagcgccttc

SEQ ID NO: 29527 - DNA, 149 bp, Homo sapiens
  misc_feature 6: n = A,T,C or G
agggangtttgtgcgggtagactccatcatccatatgtaacttgttttgaagagaagtgtttccgttgtgtgtcttgatgtaaatatttgttcatatttttgtgaattcaatactatgtaccattgtattatagtaacttttataaagc

SEQ ID NO: 29528 - DNA, 233 bp, Homo sapiens
  misc_feature 7, 25, 27, 30, 34, 35, 80, 157, 160, 190, 195: n = A,T,C or G
gaaatcnattccgagtaaaggagcngnggncttnntggtcatattgatggtctccgagtcctagaagaaagtacttcctnctactgaagctacctggaaaatcaagggtcccatttatttgggaggtgtggctcctggaaaggctgtgaaaaatgtncanattaactgcatctacagctttagtggctgnctcancaatctccagctcaatgggggcctccataacctttgct

SEQ ID NO: 29529 - DNA, 156 bp, Homo sapiens
  misc_feature 34: n = A,T,C or G
cgggtcctcagagtacaacttcccaaagcacaangcagtttttccccctaggggtgggaggaagcaaaagactctgtacctattttgtatgtgtataataatttgagatgtttttaattattttgattgctggaataaagcatgtggaaatgactc

SEQ ID NO: 29530 - DNA, 247 bp, Homo sapiens
  misc_feature 31, 144: n = A,T,C or G
agccctgagtctgcccctctctcttcctgtngtagacatcaataatcactcatgatgctgttctgagtgattattgatgtctaccatgacaaagccttgaggtcttactttctacagctccctgggcagccatttccagctggncagagttaagaggctctgccatccctggtctggatgttgtctgttttgggtctgaacgtttatatcctccaccaggatctctgagtaagttacattatcagct

SEQ ID NO: 29531 - DNA, 460 bp, Homo sapiens
  misc_feature 7: n = A,T,C or G
gaggcantgaggcagccagcgcaggggcttctgctgagggggcaggcggagcttgaggaaaccgcagataagtttttttctctttgaaagatagagattaatacaactacttaaaaaatatagtcaataggctactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacggcttaaagtttagtttaaaagttgtaggtgattaaaataatttgaaggcgatcttttaaaaagagatt

SEQ ID NO: 29532 - DNA, 205 bp, Homo sapiens
  misc_feature 14, 18, 34: n = A,T,C or G
gttaagcaagcagnaagnaagcctctggtggganaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtg

SEQ ID NO: 29533 - DNA, 427 bp, Homo sapiens
  misc_feature 16, 60: n = A,T,C or G
tacggccgggatacancagtcatcttccttgtttgtttcaccctttgttttccccccagnaggaaggagagaagattttgaaatcctttattgcaaaatgagtttgaaatagatacaaataataaatatgattgacagctatagaggagaaggaaaaaacttggctcttgttttagaaagatacttgaaaggaaaacatctatgtttattgagaagtgagaagtacatgcaaatctttcaaacataatatttgaaagtgaaaatcacgtcataggatttagagatattcccaaagtcaatatttggttcttaagttccaggtagtggaaaagtcagaatcagttaagtacccagagcacttgctcccttcctttctccatttctctctctctctctctctctctgtgtgtgtgtgtgtgtgtgtgtg

SEQ ID NO: 29534 - DNA, 496 bp, Homo sapiens
  misc_feature 47, 56, 63, 64: n = A,T,C or G
gcaggaaacccccggttttttatggcccgggggattccgggactagnaggctcagnggtgggnnagatccctgcagaacccaccaaccagcaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagtatgttcctccttttct

SEQ ID NO: 29535 - DNA, 145 bp, Homo sapiens
acaaaattggccggacgttgtggtgcacgtctgtcatcccagcaaggcaggcgaatcgcttgaacccgggaggcggaggttgcggtgagccgggatcgtgccattgcactccagcctggtcaacggagcgagactccgcctcatc

SEQ ID NO: 29536 - DNA, 490 bp, Homo sapiens
  misc_feature 6, 30, 31: n = A,T,C or G
gtccanatttctatcgtcatgagccatctnnccttacaggcggggaagttttgagcttagagaatgggatgcgtcaagaaaaccgtggctcccccagctctgttcctggattcagtgcctgttgtttcatcctgtgtagactggagtcagggtctacacagttggaattctatggaaccaagatgctgtgtggcagatggatgtggactccaactgtgacaatccagaaggccttggggacttgtttcatgaacagctccctgtaggatctctgttggggtgggggattctaggggcatctccgcagttttcttctgaaaacaaaacgaatacaagttgggcaggtgcaacaactgtgcatgcagtcccctcccagggctggctagcagtattgttgggtaccgtaagcacttagcattgttaagtgagcataagtaacaagatgcaacagcctctggccaagttttgaagattttgttttaaagtatgc

SEQ ID NO: 29537 - DNA, 146 bp, Homo sapiens
  misc_feature 31: n = A,T,C or G
ggatgcggtggcacatgcgtgtaatcccagntacccggggaggctgaggcaggagaattgcttgaatccaagagatggaggttgcagtgagctgagactgcatgccactgtactccagcctgggcaacagagtgagactctgtctc

SEQ ID NO: 29538 - DNA, 380 bp, Homo sapiens
  misc_feature 2, 11: n = A,T,C or G
anatgcccaancctgtgagttcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaac

SEQ ID NO: 29539 - DNA, 484 bp, Homo sapiens
  misc_feature 8, 31: n = A,T,C or G
gactcagnaaaattttggaaagagaagatgntcggctgatgtcatggctccgatcttcatcttgaagaagagtgacattgggtgactgctgcttggaaaactgtccacacttgctactctttgagaatgaagttttcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttg

SEQ ID NO: 29540 - DNA, 233 bp, Homo sapiens
  misc_feature 29: n = A,T,C or G
gtttcatgggtcgctcccaggctctgaanttttatgtgtgcagaatttgaggagactgagataggcttcccgaatgccgagacatgcggtgactggatagagccctgtaatcctggcttcctgagtgcccactggagttcctggcaggaaaaggccattaataccacctgaatggattaatgccgcatagatggcctccacgaaactcttgagcgtttctgggttttcttaat

SEQ ID NO: 29541 - DNA, 108 bp, Homo sapiens
  misc_feature 34, 93: n = A,T,C or G
tctgcggaagcaactggtagagttcgtcgtaganacacactacaggtacatttctagtctcagcggtgatcataagaagtcgataggcaatcncagcagccttcatac

SEQ ID NO: 29542 - DNA, 467 bp, Homo sapiens
  misc_feature 29: n = A,T,C or G
aattgccaagacgggagagaatttccgtntgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttagagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtgtccgcctca

SEQ ID NO: 29543 - DNA, 223 bp, Homo sapiens
  misc_feature 7: n = A,T,C or G
gaggccntgaggcagccagcgcaggggcttttgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcacg

SEQ ID NO: 29544 - DNA, 274 bp, Homo sapiens
  misc_feature 5, 29: n = A,T,C or G
cgtgncggctcatgcctgtaatcccagcnttttgggaggccgaggcaggcggatcacaaggtcaggagttcgagaccagcctgaccaagatggtgaaaccccgcctctactaaaaatacaaaaattagccgggtatggtggcgcgctccagtaatcacagctactctggagactgaggcaggagaatcacgtgaacctgggaggcggaggttgcacctgagccgagatcgtgccactgcactccagcctgggtgacagagctagactctgtctc

SEQ ID NO: 29545 - DNA, 266 bp, Homo sapiens
  misc_feature 3, 31: n = A,T,C or G
ggntgctgggggagggaggaatgaggagttngtacagagtttcatctggggaagatgaaaaagttctgtagacggatggtggtgatggttgcacgacagcgtgaatatacttaatgctacagaactgtacacttaaaatggctaaaatcagccgggcacggtggcacacctgtagtctcagcactttgggaggccaaggcggtggatcacttgaggtcagaagtttgagaccagcctgaccaggatggtgaagcctcatctctact

SEQ ID NO: 29546 - DNA, 273 bp, Homo sapiens
  misc_feature 6, 8: n = A,T,C or G
acaacngnaaaaaactaccgaatccaaaatatcagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctac

SEQ ID NO: 29547 - DNA, 465 bp, Homo sapiens
  misc_feature 13, 15: n = A,T,C or G
gagaccaaccagnanaaagcatttttgccttttccgatgaggaagcaggaccagaaagctcttcataaagctttaacaccatacaagtatccagcagtgatcaattgctctttataggaaaccacctttcctctggggaagaacagtctgaattaataaaacatcagagtggttgagtagtaaaaataaacacagatgtattgctttcaagtcttagagtgacataaagtagtcttaaataaatagttcttagtttattttaagcagttgattgtactaacgagatgtaattatctgaagtatttatgattagcatattggtttttataagtatttctgagttattgagggtgcttaaaaatgctgaagaaactttaaaacatgattcttcttataattttatgtgattcttatagcacaatcatttttgaaaaaggaaaactaggctgggtgtagtggctcatg

SEQ ID NO: 29548 - DNA, 189 bp, Homo sapiens
tgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagc

SEQ ID NO: 29549 - DNA, 490 bp, Homo sapiens
  misc_feature 33: n = A,T,C or G
aagctatcgagatgacaatctggctcccaacantgccaacgtccagatgaccttcctacgcctgctgtccacggaaggctcccagaacatcacctaccactgcaagaacagcattgcctatctggacgaagcagctggcaaccctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctg

SEQ ID NO: 29550 - DNA, 432 bp, Homo sapiens
  misc_feature 3, 5, 23, 29: n = A,T,C or G
ggnancaacctcggccccaaggnacaagnaagctgctaagtgttgtaatggaagcaaagcatgggactttaatgtcagcttattgagaaaaccaacaaagttttttcttttgtagtgagtctcaaagattatgtatctcattcttcaggtttattactgaggaacttggctgttggtctccactgggaaagaaacacaaggatatggaattctacttggaaaactcaggtcttcctgtttgctggataaatacagagacaaaatcacaatgagccctctcacattgatgtgaaaaaagatctttggatagaaacctactcatttattctcaggactttaagtgccctgcttcatgttttggcatgttgcaactgactttattttatttattttattacaagcaagagaaacaaagtctggttcccgtatgat

SEQ ID NO: 29551 - DNA, 458 bp, Homo sapiens
  misc_feature 30: n = A,T,C or G
gaacccctttatttttaaattttctttttntttcactggaaaggaaagatgatgctcagttttaaacgttaaaagtgtacaagttgctttgttacaataaaactaaatgtgttcacaaaggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccctgatttttatctccaagtggcagtttttaaaattggccttttacctggatataaatt

SEQ ID NO: 29552 - DNA, 468 bp, Homo sapiens
  misc_feature 34: n = A,T,C or G
ggcctcccgccctctcctataaagcagacgctgngccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaact

SEQ ID NO: 29553 - DNA, 487 bp, Homo sapiens
  misc_feature 30, 32: n = A,T,C or G
ggttgcacagggcataacacgggtgaggantnccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaac

SEQ ID NO: 29554 - DNA, 289 bp, Homo sapiens
  misc_feature 2, 5, 32, 213, 218: n = A,T,C or G
gngcncctcatttacataaatattgtactagnatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcngcggngggcctagccctactagtctcaatctccaacacatatggcctagactacgtacataacctaaacctactct

SEQ ID NO: 29555 - DNA, 143 bp, Homo sapiens
  misc_feature 32: n = A,T,C or G
acagtgcggccgagcagatggctatgtgctanagggcaaagagttggagttctatcttaggaaaatcaaggcccgcaaaggcaaataaatccttgttttgtcttcacccatgtaataaaggtgtttattgttttgttccctcc

SEQ ID NO: 29556 - DNA, 484 bp, Homo sapiens
  misc_feature 31: n = A,T,C or G
gaggccctgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaacccgaaggtgattaaaaaga

SEQ ID NO: 29557 - DNA, 127 bp, Homo sapiens
  misc_feature 127: n = A,T,C or G
tcgatgaagaacgcagctagctgcgagaattaatgtgaattgcaggacacattgatcatcgacacttcgaacgcacttgcggccccgggttcctcccggggctacgcctgtctgagcgtcgcctgtn

SEQ ID NO: 29558 - DNA, 490 bp, Homo sapiens
  misc_feature 32: n = A,T,C or G
aaggccctgtgctatcaaatgattcattgttnttacaattaggatacctaaaactagcctctccacaagccaggatgacatgtgggacttcattaaattatctcactaagtgtattccttgttttagaattcagtgaatgaaagagagtttctttccttggcgtgctggcgttcaacaatgtttgtcctgtccttactgcacagtcagtctacatgaaagaaagtcaggcctcaatttcttttctgatcaattcaacctggtgcttaaaagcaaatgtcccaaccataaatataaatttaagaaggacatatttaattttagtgtcctctgaagaaatttcttttaccatcctctctaggccaactggccaaaaggatctctcagatagggaccctgatcacaactaggacataatttacaagaggacataatttactcagatttacctaaattatcgtccccaccaacgtgcaacacccagagacttag

SEQ ID NO: 29559 - DNA, 169 bp, Homo sapiens
attccctgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggatt

SEQ ID NO: 29560 - DNA, 450 bp, Homo sapiens
  misc_feature 3, 7, 12, 33: n = A,T,C or G
agnaacnccagnatatttcccagttactcctanttctatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagac

SEQ ID NO: 29561 - DNA, 493 bp, Homo sapiens
  misc_feature 5, 6, 33, 38, 90, 97, 464: n = A,T,C or G
gggcnntgcttttttttttaaattctgtgtgtntgtgngtaaaatgccaattaagaacactggtttcattccatgtaagcattaaacagngtatgtnggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgnggattaaggggtataatacttaaattttg

SEQ ID NO: 29562 - DNA, 490 bp, Homo sapiens
  misc_feature 30: n = A,T,C or G
cttcccaaatggagcaggaagccctggtgnaggtcagactgaaccagcagctgggctcagtttgtctttggggatgtcctctgtcattgggttttctggccagactctgtgtatcatgattgcaggagcctgggtttaccaattttgaaatttcatgtcatgcaggccagtatggttctagtccaggaggcacttgttctggctgttgttcttgccatgtctttggttttatgtatgtgtgagagaatgtatgtgttgacatgtgtatacatatgcaagtgttttcttttagtgagacttttccttcgctgtatctcattgtctctgaatttcaaatgaaaatcatgtatctagtcctttccctactttactttctcctttagcattgttttgagggctcgtaagaacatctagataccctgagctcttgaggagaagggttctgaaatcagtttcattctatttaatctatttcaaatgatttaccata

SEQ ID NO: 29563 - DNA, 490 bp, Homo sapiens
  misc_feature 30: n = A,T,C or G
ggtagcagcctctctccctactgctgctantcaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgt

SEQ ID NO: 29564 - DNA, 500 bp, Homo sapiens
atttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggcttgagtgctggccctctgcgtcttccttattaacct

SEQ ID NO: 29565 - DNA, 274 bp, Homo sapiens
  misc_feature 17, 39, 76: n = A,T,C or G
tatggccgagggagacnacaggctgtggatgtgtccccnttgcgccgtgtgaaccaggccatctggctgctgtgcncaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagcccc

SEQ ID NO: 29566 - DNA, 483 bp, Homo sapiens
  misc_feature 6: n = A,T,C or G
ggagcngcggtggcgtctccacacgcaaccttgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgct

SEQ ID NO: 29567 - DNA, 182 bp, Homo sapiens
  misc_feature 17, 48, 61, 79, 91, 173: n = A,T,C or G
aacaaggcaagtgattnagtagctgggatggaatgggctggaatgtanctaaactgttctncttctacctcagcggggnctcctgcacacnctagctacagtgagaccatgagcacactgagatatgcatccagcgccaaaaacattatcaacaagccacgagtaaatgaggngagaccttt

SEQ ID NO: 29568 - DNA, 492 bp, Homo sapiens
  misc_feature 6, 7, 20: n = A,T,C or G
attcanngacaatatacagnatttactgagattatttgaatatggaggtttcccaccagcaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggtagactagtaaatttgccttacagattttttttttcttctattattcggaaaatacctataataatcaagaggctgtgggaaaacaaagcagtgcttgtatgaaaactcaagtgattaaaactgttttaaacatggctaaacctcttttaaaaattag

SEQ ID NO: 29569 - DNA, 490 bp, Homo sapiens
  misc_feature 5, 30: n = A,T,C or G
aatgncggaagcattaaattaatatataanttaataagtatgatttattgtactatagatggtgaagctttattcaagtatcaatatatgtggtcaggcaagaaatattaataataaatgttgaaaacactattcccattaagaaataagtggatcaaagtgttacccttaatgatcatatagacactgataaataatagtcaactttattactgtggttcaaaccaagtggaggttgtatgttttgtctagaaaatatataaactacaaaaagttaataaacacctaagtgaatgagtaaattaaatgtggggagtaagattcaattaagataaagtcctaattttcttttaatcaaatgctctgctttgtactccttagaatggatgcactggagctgatttaaacattctttggtggtcacaagatgtatagctgcctctgtatgtttggcgcatggaaaaaaatatgagtttttgtgaacatacac

SEQ ID NO: 29570 - DNA, 490 bp, Homo sapiens
  misc_feature 2, 5, 29, 30: n = A,T,C or G
gnctnctctcgccaggcgtcctcgtgganntgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccatttgccccatgtgaagtcacttgtgccagcccagaacactggtctcgggcccgagaagacctcctt

SEQ ID NO: 29571 - DNA, 490 bp, Homo sapiens
  misc_feature 30: n = A,T,C or G
gatctcagctttgagggctcctgtggcaanttcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtcca

SEQ ID NO: 29572 - DNA, 487 bp, Homo sapiens
  misc_feature 31, 32, 469: n = A,T,C or G
ggaagcaggaatgaaatgtgtgaagttcttnntctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatccctttncatgtcgaaaaaccgagt

SEQ ID NO: 29573 - DNA, 300 bp, Homo sapiens
  misc_feature 30: n = A,T,C or G
agggtctgagagaagggaatttggctcaanttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatcatgaagaaaactgattctctatgacatgaaatgaaaattttaatgcattgttataattactaatgtacgctgctgcaggacattaataaagttgcttttttagac

SEQ ID NO: 29574 - DNA, 490 bp, Homo sapiens
  misc_feature 6, 82, 99: n = A,T,C or G
attctngagtcccagagagaaaaaaattttatacgttgataaaacttataaatttcattgattaatctcctggaagattggnttaaaaagaaaagtgtnatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagtatagagaatgtgttgaaatttaactttgtaagcttgtatgtggttgttgatcttttt

SEQ ID NO: 29575 - DNA, 193 bp, Homo sapiens
  misc_feature 2, 193: n = A,T,C or G
gntactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcaccgtn

SEQ ID NO: 29576 - DNA, 204 bp, Homo sapiens
  misc_feature 1: n = A,T,C or G
naaccgctttagtaattactataatctcatatttatgatagttttgttaggtgacaggaccaaatgaaaatattttatgttttctcatcactttagattttatcattatgtacattactgggtttttagcatttcctaatgtgaagttttaatcacttttaagtatacatttttttctgtatcatttaaataaaatatttttag

SEQ ID NO: 29577 - DNA, 132 bp, Homo sapiens
  misc_feature 17, 36: n = A,T,C or G
aatctcacaggctgagnaactcgttcacctccaagncatttcatgaaaaagctgcttcttattaatcgtacaaactctcaccatgatgtgaagagtttcacaaatccttcaaaataaaaagtaatgacttag

SEQ ID NO: 29578 - DNA, 223 bp, Homo sapiens
  misc_feature 11, 31: n = A,T,C or G
attagcaaagnatggtcagcgaaatcaacantagctttgaagtagacccagatagatacaggaacttaatataaaggtacagtttcagaacagtgtggggaaaatgctattgagatctcaccatctagaatgaaaaaagaatgacccctcatactgtacacctgcaaaaataaattatagatggatacggatttaatgtaaaagcaaagccataagctattag

SEQ ID NO: 29579 - DNA, 362 bp, Homo sapiens
  misc_feature 4, 6, 25, 32, 35, 60, 67, 70, 153, 185: n = A,T,C or G
aagncnacatcgagacccctgtgantaagttncgntgccagaaatggtgggacttgtcgnggcccangcnttgctggggaaagccacgtgccgatgtgcctcagggtttacaggagaggactgccagtactcgacatctcatccatgctttgngtctcgaccttgcctgaatggcggcacatgcnatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgaga

SEQ ID NO: 29580 - DNA, 105 bp, Homo sapiens
atattaatatttacctgcattccacattaaagggttcagtttatgacttgtgtcctgtcttgtagatacttaattaaacggtattaattttgattttgccccttt

SEQ ID NO: 29581 - DNA, 410 bp, Homo sapiens
  misc_feature 1, 22, 24, 27, 29, 30, 68, 74: n = A,T,C or G
nataacaatattagtttggtgngnatngnntgaaaatagcttaaaggactacatgttttacccatttngacttnggtatttccttgtgtgaagtgacaaaatcggggctcttgtatcagtgccagctgtaaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccataaaattaaattagttatattttat

SEQ ID NO: 29582 - DNA, 421 bp, Homo sapiens
gtctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaat

SEQ ID NO: 29583 - DNA, 316 bp, Homo sapiens
  misc_feature 25, 32: n = A,T,C or G
gaatggcggtatgaggcctccgagnatagctnagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttt

SEQ ID NO: 29584 - DNA, 331 bp, Homo sapiens
ctattctgttccattggtctgtgtgcctatctttatgccagtaccatggtgttttggtgactatggccttatcgcatagtttgaaatcaggtaatgtgatgcctccagatttgctctttttgcttagtcttgttttagttccatatgaattttaggatttttttttctaaaaccctaaagattcctccagaaagctcctagaactgataaaagaattcaccaaagtttccggatacaaaatcaatgtacacaaatcagtagctcttctatacaccaacagcaatcaagctgagaatcaaatcaagaactcaacccctattataatggctgc

SEQ ID NO: 29585 - DNA, 162 bp, Homo sapiens
  misc_feature 7: n = A,T,C or G
gagggcnactagatggatttaacaaagacttcggagttgtgtatgtgtgtatgtgttttttcaaagaactaaaagaaaccatactaatgaagtaaatgaaagtatgattactatactttcaccaaatagagaatgtcaacacagagctagaaattttttgcg

SEQ ID NO: 29586 - DNA, 360 bp, Homo sapiens
  misc_feature 41: n = A,T,C or G
tatggccgggattggcattaacctggtgctggatattttcnaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctacc

SEQ ID NO: 29587 - DNA, 151 bp, Homo sapiens
  misc_feature 33, 36, 57, 58: n = A,T,C or G
gctgaatataacctacttagtatcactaggcgncgngagcgaagatgccttatgacnntgtaagacctactacgtgagatttgaatgatgcaagagaagacccagtgctacccgccttctgtcttttaactttaggaataaaattagtttc

SEQ ID NO: 29588 - DNA, 109 bp, Homo sapiens
  misc_feature 32: n = A,T,C or G
cgggacgctaaggcaagcacaatcacgtgatnccgggaggcggagcttgcagtgagccaagatcgcgccactgcactccagtctgggcgacagagcaagactccgtctc

SEQ ID NO: 29589 - DNA, 355 bp, Homo sapiens
  misc_feature 6, 31: n = A,T,C or G
agaacntgattccaaatcctttatttttgantatatgacatagtacatagtcttcctccctgaccctcccaccccgcattcagacatttatttatatttgacaaagaataactgaaaatatgctgagggactaacattggaatgaaaagcaaaaatgcgagtgtacataagaatgcaggtttctagaatgtatttatcttataaggatttattgagcccttactgtgtgctaagtgatgctctagttgcagtttaaatagtgaataagacagagaaaatccttgtgtatatttccagaggagggagacaatgaacaagtgagccaacaaacaaatgagttaattgaaatttatgc

SEQ ID NO: 29590 - DNA, 377 bp, Homo sapiens
  misc_feature 2, 12, 45, 47, 57, 60, 72, 75, 81, 82, 83, 86, 88, 90, 97,105, 108, 112, 158, 182, 203, 221, 250, 314: n = A,T,C or G
tnggtgaagcangaacgcaatcaagatgccttgtttattatcctnangcttattacncgntgaaccttgacngtnacgctnnnatntntngaaaggnaatctttnacngggnaaaatatttacctttcttgttcttttctactcccatatgaaaaagnaattttttttctgtatgatatggngtagctttcatcctatagtgngttcaagatgctcatatncaaatgtaaatgtacatttaaaaggtagngatttttcaacaagggcgccaagaccattcagtgggagaaagaacagtcttttcaacaaatggngttggaaaagctagatatccacatgtaaaagaatgaaattgggtccttatcttacaccatctg

SEQ ID NO: 29591 - DNA, 202 bp, Homo sapiens
  misc_feature 162: n = A,T,C or G
atactcagagtccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgnatgttcattatttgtacataaaataaaaccatttaaaaag

SEQ ID NO: 29592 - DNA, 126 bp, Homo sapiens
  misc_feature 6, 24: n = A,T,C or G
gtagcnccagctaaataaaggacngtagaggtgggaagattgcttgagcccaggagtttgaggttgcaagagagctgatcatgccactgcactctagcctaggctacagagcaggaccccatctcc

SEQ ID NO: 29593 - DNA, 458 bp, Homo sapiens
  misc_feature 28: n = A,T,C or G
ccacagtttcttgaagacgagtaccctnacatgcccactgaaggcataaaaaatcttgttgactttctcactggtgaggaagtcgtgtgtcacgtggctagaaacttggctgtggagcagttaacactgagtgaagaattcccagtgcccccagctgtgttacagcagactttctttgcagttattggagccctgttacagagcagtggacctgagaggactgcacttttcatcagggacttcttaattactcaaatgactggaaaagagctctttgagatgtggaagataataaatcccatggggctattggtagaagaactgaagaaaaggaatgtttcagctcctgaatcaagacttactaggcagtctggtggcaccacagctttgcctttgtattttgttggcttatactgtgataaaaagttgattgcagaaggacctggggaaacagtatt

SEQ ID NO: 29594 - DNA, 305 bp, Homo sapiens
  misc_feature 6, 33: n = A,T,C or G
attgtnctgcaggccccacttccacagcacctnacaagctaagacccactggcttggaattggctcccaacgggttttcagcaacttcctgcaggtgcattcaggccagcaacagttcaggaccccctgggacagagtttccagaggaaggagcaggctgccatctttgctgtttcacagccttcactggtgatacctccaggtatgggaaaaaccgaggcaactagggtctggagtggacccccagcaaactgcagcagccctatggaagagtggcctgactgttaaaagtaaaacaaataagc

SEQ ID NO: 29595 - DNA, 277 bp, Homo sapiens
  misc_feature 7, 8, 30, 270, 275: n = A,T,C or G
ggaatgnngagactggcaacctgaaaaagntgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatganctcancc

SEQ ID NO: 29596 - DNA, 132 bp, Homo sapiens
cgtgcgtcgatgaagaacgcagctagctgcgagaattaatgtgaattgcaggacacattgatcatcgacacttcgaacgcacttgcggccccgggttcctcccggggctacgcctgtctgagcgtcgcttac

SEQ ID NO: 29597 - DNA, 488 bp, Homo sapiens
  misc_feature 6, 30, 32: n = A,T,C or G
gaacgncaggcgtcccgcgtcgctagctantngttctgaagcggcggccagtagaagcagtcaagggcacgagcatcggccatgcctttcttggacatccagaaaaggttcggccttaacatagatcgacggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatatctggaggctgattttcctgttctctgttctccactggaaaaggttgtttacgacaaacctccttgtc

SEQ ID NO: 29598 - DNA, 343 bp, Homo sapiens
  misc_feature 21: n = A,T,C or G
agaatggtgtgttgggaaacnccttggaaggtgtgcatgtggaagaggaagaaggagaaaaaacagaagatgaatctctggtagaaaataatgataacatagatggtatgtggagttgcatgtgacattcaagagatgcgacgttgtatatttcttgtatacagtggtggaaacggggctctacctgtcctggatggtctctcctaagatgcttggggtgatgatgcctgcatctggtggagattgcagtggggatagctgtttactgaagctgacagcagatttttgaaagagaataacttattttctcaagtaaatccagttatttcgattggggtttttt

SEQ ID NO: 29599 - DNA, 203 bp, Homo sapiens
  misc_feature 1, 8, 31, 33: n = A,T,C or G
naacaacnagactgtagcaagaggccgcgcntngtggctcattcttgtgatccgcccgcctcggccttacaaagtgctgggattacaggtgtgagccactgcgcccggcctttttcttttcgtttctagtacattttggaaggactttacccctcttcctctttaaagcatccaagtcatgcattttctaccttaattttacc

SEQ ID NO: 29600 - DNA, 469 bp, Homo sapiens
  misc_feature 32: n = A,T,C or G
aatataacgtgtacataaactactgtagcacnttgcatatataaacataattaattttaacatccccatgaagtcaaaattatatctattttttaaatgatgaacatgtgaactattgaatctgctgtacatagttatgtatagtattgcacaatgtttctttacatttaaaactatgacctcttcaattttctattttattagtttttggaaaattatttttataactgcatgatatgtcatggtattgacgtgccttaatttaacaagtccacagtcattatatgataaaattatgctcaaattttcacttctaaaaatgatcttatatataataattgtataccaatatttctgtaagtatttattttcttcttaaaaattcctggaagtggaattattggtcaacttatgattaacatatttaaggaggtggaacctagtgttgcagaatatgggttctagagat

SEQ ID NO: 29601 - DNA, 461 bp, Homo sapiens
  misc_feature 10, 58: n = A,T,C or G
aatcaccagnagttaaagaattctggtgcccttctttaagtcttcaggaagtgtttanaggcttattcacattagttaaaacaggccccccccaccttccccaaggcaacagaaaacataaccattagctctcttcctgttttccttcctcatttcatgcttgcttcggctgctaaactgaatttttgttacttagaatattataaagtgtggatgctttctataatgctattggtctaagtgtgattaaatttcattaaggtgtataagcctctaattattacataactggcacgtctgacttttgctatcatttgaggattctactgtatataagtttcatctaacattggcattaataaccacaggtatattccaactaattgttacttcttgtaattgccagactacttcaagagttctcgtaagttttagattttcagagacccatcttcaatact

SEQ ID NO: 29602 - DNA, 227 bp, Homo sapiens
  misc_feature 3, 32, 227: n = A,T,C or G
cantaccctacttaatggatgtgaaatgcctnggatgctataaaatcaccacggtcttagccatgcacaaacggtaagttttgtgtgttggctgctccactgtcctctgccagcctacaggaaggaaaagcaaggcttacagaaggatgttccttcaggaggaagcagcactaaaagcactctgaatcaagatgagtgggaaaccatctcaataaacacattttggn

SEQ ID NO: 29603 - DNA, 488 bp, Homo sapiens
  misc_feature 3, 29, 30, 32: n = A,T,C or G
ggnagctcacaagttacaatcatttgatnntnacccgcaagttttatgggctcgtcttttgttgttcatccttgctaggtcaagctttcagatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatctccagctgctgggggagtctgtgagcccttgaagtctccgcaaagagcaga

SEQ ID NO: 29604 - DNA, 470 bp, Homo sapiens
  misc_feature 1, 9, 31, 34, 60, 61, 174, 175, 189, 273, 349, 438, 452: n = A,T,C or G
natacaccnacagttgttttggaaggctttnttnaaactaaccttggaatgaaaagaaannattcctctttctccttacaggacgtagataggctgcatgcctagaggcatacagaaaatggaaatagtatttcgctgtcctgaaactttcagtgaaagagatcacccaacatnnataacttgtcatantattctctccctccctaagtattctacaatggaaagaatggaggaagcacttcaagtagccatcaacaacaacagaggatttgnctcacccatgctcacacagtcataatcacctctgagagactcagggtgggctttctcacacttggatccttctgtncttccttacacctaaataatacaagagattaatgaatagtggttagaagtaagttgagggagagattgggggaatggggagatgatggngatggtcaaagggngcaaaatctcacacaaga

SEQ ID NO: 29605 - DNA, 145 bp, Homo sapiens
  misc_feature 1, 3, 111: n = A,T,C or G
ncntaaactcaaaagtccaaactccgtagtcttattgaaatcaaatagaaacataaataaataaatgaatgaataagcaaacagatcagatacatgtctgaaactcaaggngctatcatcccaaggcacgattcctctcccactg

SEQ ID NO: 29606 - DNA, 450 bp, Homo sapiens
  misc_feature 2: n = A,T,C or G
gnatcccatcgatggccttgtccatgttgttctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctcttt

SEQ ID NO: 29607 - DNA, 467 bp, Homo sapiens
  misc_feature 8, 58: n = A,T,C or G
caacatcntttggaagatgaaactgttgcttttgtaatgccaatgaagatacaagttnctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagctcatggaagagaatgaatctcttaaacaggaactggctaaagctaaaatggctcttgcagaggctcacttggaaaaagatgc

SEQ ID NO: 29608 - DNA, 186 bp, Homo sapiens
  misc_feature 5, 7, 183: n = A,T,C or G
gtttncnagggttaaatattcagcacatagttggtattcaggaaatgataggtgaagttattatttagtattgaataaatataatactgttaacttactccttttgatatgtgtggctcctgtgtttaagagttagttgtttatccttaagaagtttgataatcagtttcaaaaatctagctnacc

SEQ ID NO: 29609 - DNA, 123 bp, Homo sapiens
tgtagtcccagctactcaggaggttgaggtgggaagattgcttgagcccaggagtttgaggttgcagtgagctgatcatgccactgcactctagcctaggctacagagcaggaccccatctcc

SEQ ID NO: 29610 - DNA, 234 bp, Homo sapiens
atgaagtttttttctatagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtattttt

SEQ ID NO: 29611 - DNA, 306 bp, Homo sapiens
  misc_feature 7: n = A,T,C or G
agaacancagagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacttatataccactttctcgtataaatttttcaaaaaatacaataataatataatttataaagaacactcttctatgaacaaccaccacca

SEQ ID NO: 29612 - DNA, 460 bp, Homo sapiens
  misc_feature 7, 9, 19, 36: n = A,T,C or G
caagaancncagcctgagnaaggaacaaccagagtnagtaagtaaaataaatgggaaatgtgatgatgcggaaaccaagggaattaaaatcaagaaagatagtggtcaagaaatacctatttttgcaattactaggtaattagttaaccacaagcaaagtagtacattgaggtgatagaggtggaagccagataacagttaggttaagagacaagtggaagttgtggtagtaatataatttactaccacattatatgtgtcaatataattttagagtactctataggaaagcttgtctgaaaagagatgacaaacaattagagggagtcccgggatttatttagactaattttaaaaattctaaaccagttaatgtagaagcaatgtacattttctatacagggcttcttcactttcaggtttttttttctatcagttgttatacctttatgttaattga

SEQ ID NO: 29613 - DNA, 170 bp, Homo sapiens
tacatgtgtgcaacatctggctaaatatactgccctgacactaaaagttaagtgaatgaattaaaacactgattgcctttcctgtgttgcatcctctgtgccgtgggaagaaagaaaatggatgctttttggggaaataaaaaggaaagtaagaaacctaatatctaacc

SEQ ID NO: 29614 - DNA, 152 bp, Homo sapiens
  misc_feature 4, 5, 29, 39: n = A,T,C or G
agcnnatgttttaattcctaatctttatntacaacaagnaaaaatgggaatgatagcaacacttttcttttaaaagcattctgattctttcactgtttctggtgatttttttttttaaggcaaacatcaaaaggggaagaaagtcatctttt

SEQ ID NO: 29615 - DNA, 490 bp, Homo sapiens
  misc_feature 4, 33: n = A,T,C or G
gagnttccacttttctctttagtgttctgtttnaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcggtggtgggagagatccctgcagaacccaccaaccagaatgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttca

SEQ ID NO: 29616 - DNA, 299 bp, Homo sapiens
  misc_feature 33: n = A,T,C or G
cagctccagaaggatgggatatccagttttctnaacaactgttctcttgtacttgtcaaagccaaagtgtaacaacacatcaagtcactttagcaatttatttttgagaccagcctgagcaacatagtgaaatcctgtctctacaaaaatatgtatatataaattagtcataatctcagctacttgagaggctgaggtgggaggatcacttgattccagaggcagggcttggttgcagtaagcagagatcacgtctctgcactccagcctggctgacagagtaagaccgtgtttcacct

SEQ ID NO: 29617 - DNA, 452 bp, Homo sapiens
  misc_feature 67: n = A,T,C or G
atggccggggaagacctgactacatatcaaggcagaaggttctgcacgagagaatgcaacggatgcnatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttatt

SEQ ID NO: 29618 - DNA, 179 bp, Homo sapiens
  misc_feature 9, 29, 35, 43, 49, 69, 80, 96, 121, 148: n = A,T,C or G
gaaaggcanggaggaaccttatctatganaaagcnaagctctntcacanggaatatgggcagatgtacngaactgaaatncgattggcgaggatgncgagaaaagctggcagcttctatgnacctgcagaacccaaattggcgtctgncatcaaaatcagaggcatcaatggagtgagc

SEQ ID NO: 29619 - DNA, 352 bp, Homo sapiens
  misc_feature 7, 32, 34: n = A,T,C or G
ggaaggnccttctcatgcaaaaggaatcgtgntngaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgt

SEQ ID NO: 29620 - DNA, 475 bp, Homo sapiens
  misc_feature 31, 33, 59: n = A,T,C or G
aaggtaccagggatccagaggtatatgcttntntactgaatctctctcagtctattggnaggttgctgaaggatgagcagctaaaagtttgttgcgttttatgcattttgagtttgaagtccctgtgagacttcaaactggaagttttcagtggacacttggtatatagtagtatagaacttggcagagaggccggcacagtgactcaacacctgtaaacccagcactttgggaggttgaggcgggtgaattgcttgagctcaggaatttgagaccagcctgggcaacatggcgaaaccacacctctaccaaaataaaaatttaaccaggtgtggtagcacatgcctgtgggcccatctactagggaggctgaggtgagaggattgctggagcccaggaagtagaggctgcagtgagccgtgatcacaccactgcacttcagcctgggtgacagagcgagacctttccacgttct

SEQ ID NO: 29621 - DNA, 123 bp, Homo sapiens
gtatttggaaacgcggagtgagtttttccgtgctgtgtaggggctaacaatggacacccagaaggacgttcaacctccaaagcagcaaccaatgatatatatctgtggagagtgtcacacagg

SEQ ID NO: 29622 - DNA, 345 bp, Homo sapiens
  misc_feature 2, 12, 38: n = A,T,C or G
anaaactgtgtntgaggggaagaggcctgtttcgctgncgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcc

SEQ ID NO: 29623 - DNA, 469 bp, Homo sapiens
ctacaccaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaacccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaagg

SEQ ID NO: 29624 - DNA, 453 bp, Homo sapiens
  misc_feature 7: n = A,T,C or G
catctcngtttaggggcgcagccagctccttttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggttatggggggagttttagctgtgtttcttg

SEQ ID NO: 29625 - DNA, 468 bp, Homo sapiens
  misc_feature 30, 32: n = A,T,C or G
gaaatcgaagcttttaaagctcctggtctnantaattcctcagaataaacctctttaaaagggatattgatggaaatgtacaattaccagtaattgaggttttatctgaggggatggagatgatgaaatggttccttcttggaagttgttggcattttggctttatttttcacaaataaagtgaaaccatttaaaacgattgacaacgattatatagtgccatgtggaatacaatagatattaatttgtggttggtttttctgcctgctttaaatgaaatgtattatgtttctgggttccttttttagctgtaaaaatacttcgtcactaaagcatgaaatttaatcagcagttgttcttcaagttcctgaaagctataaaagtttctcatgacttgagtggttttttccctgcccaccagaggagaaagcccttgtagaattctgcagtgttacaagtgttccctac

SEQ ID NO: 29626 - DNA, 192 bp, Homo sapiens
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgg

SEQ ID NO: 29627 - DNA, 199 bp, Homo sapiens
  misc_feature 199: n = A,T,C or G
agtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatcan

SEQ ID NO: 29628 - DNA, 499 bp, Homo sapiens
  misc_feature 5, 14, 41, 50, 59, 92, 100, 122, 130, 182, 190, 287, 412: n = A,T,C or G
tgaancctttgagnttctcatttcctcctaatacagagcanccacgctcnctggatatngaagctgcagcctatgcactgcgctcacacttnttacaatntcagacttctgagggaatcccnattatgangtggctaagcaggcaaagaaatagctggggtggttttgcatctactcagganaccactgnggctttaaaggctctgtctgaatttgcagccctaatgaatacagaaaggacaaatatccaagtgaccgagacggggcctagctcaccaagtcctgtnaagtttctgattgacacacacaaccgcttactccttcagacagcagagcttgctgtggtacagccaatggcagttaatatttccgcaaatggttttggatttgctatttgtcagctcaatgttgnatataatgtgaaggcttctgggtcttctagaagacgaagatctatccaaaatcaagaagcctttgatttagatgttgctgtaaaaga

SEQ ID NO: 29629 - DNA, 343 bp, Homo sapiens
  misc_feature 3, 5, 29: n = A,T,C or G
ctncnccggcggtgacgacctacgcacantagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgg

SEQ ID NO: 29630 - DNA, 406 bp, Homo sapiens
  misc_feature 6, 8, 31: n = A,T,C or G
cagcancngctctgaaaatagtgcctggganttgccagtgtttcagaattcataatggtgcacatggaatcagctcatcctgcaaacatctcccacccgtggctcaggacaaagaaaaaatcaggccgggcgaggtggctcctgcctgtaatcccagcactttgggaggctgcagcaggaggctagcttgagcctgggtgtttgggaccggcctggccaacatggtaagacctcgcccctgcaaaaaatagaacattagctgagcgtggtggctcatgcctgtggtcccagctactcaggaggctgagatgggaggactgcttgagcccagggaaattgaggctacagtgagcagtgagagcgccactgaactccagcctgagtgaagggagtaagaccctgtctc

SEQ ID NO: 29631 - DNA, 318 bp, Homo sapiens
  misc_feature 30, 32: n = A,T,C or G
aataggcttggtcctagcctttctattagntnttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccct

SEQ ID NO: 29632 - DNA, 305 bp, Homo sapiens
aaagtgacttttaaaggcccatcacctgagtactagggtaatcatctttacttctggttcctgaaatcatatttttccagtggaccatcctccagtggctgtggttgttgagcatgctttcagaacacctatgtggcttaaaacttagtttatgttttgtgttcaacactacgtgtaatattttaaaactgtttaatgtgatgtgaatacatttatgtacatttatttttaaatttgtaaatagctttaaattgctatggcaatgtttcttttataaatcatcaaaataaacctttgtgaattga

SEQ ID NO: 29633 - DNA, 279 bp, Homo sapiens
gggtctcaactttgtcacccaggctggagtgcagtgatgtgatatcagctcactgcaacctctgcctccgaggctcaagcgatcctcccacttcagcctctctagtggctgggactacagacacgtgccaccatgcccagctagtttttgtatttttagtagagatggggtttcgccatgttggctggtcttgaactcctgggctcaagcggtccaccctcctcagcctcccaaagtgctggaatcacaggcatgagccactttcatgactttgtctcg

SEQ ID NO: 29634 - DNA, 464 bp, Homo sapiens
aggtcatctacaacttatcacttgtatttagagtttagtcacttaataaatacctttccttcttaaatcacattacttagatagtctacagtgcccatatggaagaattattagaaaaatttagtgtttagcagcacacataccaaacacgtggataagtaggctaatgatgatgatgatgatgagtatttactgtgcacttatagtagttcatattatggcgtttaattctcacaaaaattccatatgataggtactcttttagtccctttttacagtgagtaaacttaggcatagagaggttaagtgattgcctgaggtcacactgtcattaatgaaagagtggatatttgagccctgaatctgctgatgctagcacctgctcttaaccacagctgttaaaaacatattgtcaattacatgcagcatggttagtaccactcagtattatgccaagtaaatta

SEQ ID NO: 29635 - DNA, 463 bp, Homo sapiens
  misc_feature 32: n = A,T,C or G
ggattcctgagctgacagcattcgggccgagnatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgcttttt

SEQ ID NO: 29636 - DNA, 136 bp, Homo sapiens
  misc_feature 21: n = A,T,C or G
gggacagccccgctcccagangtaaagaacgcgacttccacaaacctggattttttatgtacaaccctgaccgtgaccgtttgctatattcctttttctatgaaataatgtgaatgataataaaacagctttgact

SEQ ID NO: 29637 - DNA, 487 bp, Homo sapiens
ggggcattgtacaagcgcgtcttgcagctgcaccgtgttctgcccccggacctcaaatccctgggcgaccagtacgtgaaagacgaatttaggagacataagaccgttggttctgacgaggcacagcgtttcttgcaagaatgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatattttaagctttgaaaacacctgttattaatgaaatactcttttattttggatattattga

SEQ ID NO: 29638 - DNA, 221 bp, Homo sapiens
agatcatgaggtcaggagttcaagaccagcctggccaaatggtgaaaccttgtttctactaaaaatacaaaaattagcccggcgtggtggcaggtgcctgtaatcccagctactcgggaggttgaggcggaagaattgcttgaacccaggaggtggaagttgcagtgagcgagatctctgcactgcactacagcctaggcgacagagcgagactccatccc

SEQ ID NO: 29639 - DNA, 254 bp, Homo sapiens
tatggccgggcaagccaagcatataatattacagcttaatgtagagatccacatttgttcggaatctgttgatcctgggtttacatcccttgttctttctaagctgaagtttcctcatcaatagaataggaataatattatgtgcatcacctcataagattgtttaaaagattgagatgattctttgaagggcttagtatagtacctggcacatagtaagtacctaataagtatatgctattgttaattgtatc

SEQ ID NO: 29640 - DNA, 481 bp, Homo sapiens
gtttatttcttctgtagatgccatttctattggaatcaggagacccatagttaagaattcattcatctttttaaaagtatcacttaaatgtggaacatggtagagtaattaaggaaatgtaatctatggatttttccttaaaggatctttttatatgtggaggagataagatctacagaattgcctatgaacaagagatttactaaacatctaaaccactagcggtgattctcaaccatttcaaattcttcacctgcccccaattttaaaacatatattttgtgacactccctttaatattctaaaatgaaatttataggtaatattatttatatactaataggtagaattagtataatgctcaaattctaacataaagaataaataaaaggaaaatactttataataaaataatatgtatttcaacatgagaatgactatctaaaagatacaatatttatgcccatcttggatggatatg

SEQ ID NO: 29641 - DNA, 461 bp, Homo sapiens
  misc_feature 18, 22: n = A,T,C or G
cggaagagataccaagtncagnagcaacaaatagaggcctggcctccaggtgccggatccagacacctgacctagaatgcctgcccgctatccctgtggcaggaaatatcccctcatgtcccagggaattgcagatgggtcttctatacccttctacctgcccttagatctccatttttatcaaatagtacattgcattttgaagttttgggttttgtccttcatctttccctttcccttcaaatcttttaatggtaagaaagcaagtgaagcttggtgcaagctaaaatttttaaatggtgtggaaatgcaaataataccaagtaaaataatacagatattattaaagtttctggttttgaggtgttgtagataaatgtatttatgtgcctagtggggaatccaatattatgaatatgaaaaagggggcaataaaagggtatgtaaaatatgtatgaaga

SEQ ID NO: 29642 - DNA, 255 bp, Homo sapiens
  misc_feature 5, 10, 19, 69: n = A,T,C or G
gtaanctccnttgaacccntttttcaacttaaggtctgcatagcagacttttaaaaccttgggatttantctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtat

SEQ ID NO: 29643 - DNA, 483 bp, Homo sapiens
gctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaaca

SEQ ID NO: 29644 - DNA, 483 bp, Homo sapiens
ggtgcctcatgcctgtaatcctagcactttaggaggccagggagagaggattgcttgagcccaggagttcaagaacagcctgggcaacatagtgagaccccatttcttaaaaaaagaaaaagaatatgcccagggtcacacagctaataagtggcagaaccaggattcaaacactggcaatctggccctagtgcctgggcagttgtccagcaggccatattgcctctctgcttagaagagtgcctgatgtgtattaagctctcaatagatgttaattattgctgtcatcaagaaagagaatattcagggccgagcacggtatctcacacctgtaatcctagcactttgggaagccaaggtgggaggtgggtggatcacttgaggtcaggagttcaagaccagtctggccaacatggtgaaaccatgtctctactaaaaatacaaaaattagccgggcgtggtcgtgggtaccttgtaatccca

SEQ ID NO: 29645 - DNA, 248 bp, Homo sapiens
  misc_feature 16, 24, 29, 34, 74, 82, 111, 135: n = A,T,C or G
tggcccggggaggccnttgaggcnagccnagcgnggggccttcttgctgagggggcaggcggagcttgaggaanccgcaganaagtttttttctctttgaaagatagagantaataccaacctaccttaaaaaantatagtcaataggttactaaagatattgcttagcgttaagtttttaacgtaattttaatagcttaagattttaagagaaaatatgaagacttagaagagtagcatgaggaagg

SEQ ID NO: 29646 - DNA, 311 bp, Homo sapiens
  misc_feature 19: n = A,T,C or G
aagggaagatgaataattntaaccaagctaatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtcc

SEQ ID NO: 29647 - DNA, 464 bp, Homo sapiens
gtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcacagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataat

SEQ ID NO: 29648 - DNA, 475 bp, Homo sapiens
gagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttgggggtgggcttggaacacaggtgtgtacagcgtgctgtagtgggaagttttgtatcatagt

SEQ ID NO: 29649 - DNA, 293 bp, Homo sapiens
  misc_feature 289: n = A,T,C or G
atagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgccccagaacctttgaatcccttggaaatttactggtaggccaaagaggacagctntttg

SEQ ID NO: 29650 - DNA, 226 bp, Homo sapiens
  misc_feature 3: n = A,T,C or G
gangttgaacttgttgctgagggcaacagcaggttcacttacactgttcttgtagatggctgctctaaaaagacaaatgaatggggaaagacaatcattgaatacaaaacaaataagccatcacgcctgcccttcctcgatattgcacctttggacatcggtggtgctgaccaggaattctttgtggacattggcccagtctgtttcaaataaatgaactcaatcc

SEQ ID NO: 29651 - DNA, 131 bp, Homo sapiens
  misc_feature 27, 59: n = A,T,C or G
atggccgggatcccagctactcaggangcagaggtgagagaattgcttgaacccaagangcggaggttgcagtgagccaagatcgcgccattgcactccagcctgggcaacagagagagacttcgtctcag

SEQ ID NO: 29652 - DNA, 463 bp, Homo sapiens
  misc_feature 10: n = A,T,C or G
gaagtccgantggagagtagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcaccatgtgatgacaaaccttggagagaagttaacagatgaagaagttgatgaaatgatcagggaagcagatat

SEQ ID NO: 29653 - DNA, 478 bp, Homo sapiens
gaggcattgaggcagccagcgcaggggcttctgctgagggggcaagcggagcttgaggaaaccgcagataagtttttttttctctttgaaagatagagattaatgccactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatcttttaaaaagagattaaaccgaaggtgatt

SEQ ID NO: 29654 - DNA, 108 bp, Homo sapiens
agatgaagctggaagtggattggacaatggtgacttcaaggtcacaactcctgacatgtctaccacccaacacaataaagtcagcacatctcccaagatcacaacagc

SEQ ID NO: 29655 - DNA, 312 bp, Homo sapiens
agtttggtgttggcttttattctgcctacttggtggcagagaaagtggttgtgatcacaaagcacaacgatgatgaacagtatgcttgggagtcttctgctggagattccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaga

SEQ ID NO: 29656 - DNA, 159 bp, Homo sapiens
aagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcg

SEQ ID NO: 29657 - DNA, 359 bp, Homo sapiens
  misc_feature 25: n = A,T,C or G
cattctgaattaagttgaaattttnacatttatactttaactgttctaaatttaagcctacatgtaaatctttttggggggaaggtaacttgaaaagtttaacttgaaaatttgacctttaaactttcatattctaaggtaaataatagcctataaccaacaacagctttcccagaggtcttgaatttaacactaattgtttagttattgtttctatttctcatacatacataacttcgttttttgtggctggaagaaaaagtttctatattttgtatttgtctttgttcttctcatgcacacaatttactgttggtgtttaataatttggagctcataaaattaaaagttgtaatttc

SEQ ID NO: 29658 - DNA, 488 bp, Homo sapiens
  misc_feature 37: n = A,T,C or G
gaagtggagtgaggggtaacaagcatggcgaccgagnacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaactacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctc

SEQ ID NO: 29659 - DNA, 462 bp, Homo sapiens
  misc_feature 2, 4: n = A,T,C or G
cntntgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaaga

SEQ ID NO: 29660 - DNA, 469 bp, Homo sapiens
  misc_feature 1, 4, 81, 114: n = A,T,C or G
natntgcctgtgttcatgaatctcagactgtgttcactttccaccacatttaaatagtaattgtgaatttgtaatgcccanacaagtggtctaaacactctggaatcagtggtngttcaaccagaggcttggttaagaggagcagtgttccaggtggaagaaaggcccacatgcctgaaggctacatggggtcctgtgcgttctgactccagtctacaacagactagatgaagatttgacagaccccatgtgataactgattctctgcaatgtcctgattaaatctgttgttctgtttctgtttaaatccaccacaatatttgtggattaaaatagattgtgttgatgtgacacccgtgtgcaacccagagaaaaaaatagattatacttttcaaaataaaaaagcttttgtgcttcaagggacattatcagagtgaaaagacaacctggagaatgggagatatatttt

SEQ ID NO: 29661 - DNA, 468 bp, Homo sapiens
  misc_feature 121: n = A,T,C or G
ggtaaagtaatatgcagatagtctaaattcttttgagtttctaggtgtaagcagactaaatgttgcccagaatcagtgttgggttatcagtttatattaaatatactgagttgcccgtttngaaaatgcactttgaataatctcaaaaagatgtacaagttatacctgtaaaccacaaaagtgaagcctgaggcttctgttcaatttcatagactcctttaccatgtaaaatttgtctgatatttgatttgtgatacaatttctcctgctaaagctgctattattctgacaaggtagaggtccaggttcacctttatatatatttaaaacaattagtactgaattggacataaaaatattgacattctaaggagagatatatgtcagcatttttctggtactcaaataagttagtaggtaaagtctgcaagggcataaatttagggggaaaaagtgtcccagttctct

SEQ ID NO: 29662 - DNA, 310 bp, Homo sapiens
  misc_feature 6, 14, 29: n = A,T,C or G
gacttntcacaagnaggcgccgaagcgantaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattg

SEQ ID NO: 29663 - DNA, 230 bp, Homo sapiens
tatggccggggaggcattgaggcagccagcgcaggggcttctgctgagggggcaggcggagcttgaggaaaccgcaggtaagtttttttctctttaaaagatagagattaatacaactacttaaaaaatatagtcaataggttactaagatattgcttagcgttaagtttttaacgtaattttaatagcttaagattttaagagaaaatatgaagacttagaagagtagc

SEQ ID NO: 29664 - DNA, 195 bp, Homo sapiens
tgagatataaagctttaagatatatgtatgtgtttatagagagttgaattttatacacatctaattatatgtgtgtaacagtgtacctggcgtggtggaattttttatttagaggtgaacatagaaagtcatgttggaacagcatcctttaggtgaagaattggggcatattttgactttggaaaatggtatacg

SEQ ID NO: 29665 - DNA, 461 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatggcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatcttttaaaaagagatt

SEQ ID NO: 29666 - DNA, 250 bp, Homo sapiens
ggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattg

SEQ ID NO: 29667 - DNA, 411 bp, Homo sapiens
  misc_feature 411: n = A,T,C or G
tatggccgggggggctcctatttctttacattgtgtgcacaccaagtaaccagtgggaaaactttagagggtacttaaaccccagaaaattctgaaaccgggctcttgagccgctatcctcgggcctgctcccaccctgtggagtgcactttcgttttcaataaatctctgcttttgttgcttcattctttccttgctttgtttgtgtgtttgtccagttctttgttcaacacgccaagaacctggacactcttcactggtaacatattttggcaagccaaccaggagaaaagaatttctgcttggacactgcatagctgctgggaaaatgaacatcagtgttgatttggaaacgaattatgccgagttggttctagatgtgggaaagagtcactcttggagagaacagtn

SEQ ID NO: 29668 - DNA, 380 bp, Homo sapiens
ggagctcaaacaactctatgggaaaaaaatctagtaattcaattaaaatattggcaaaatatttgaaaagacatttatcaaaagaagacatacaaatggcagacaggcatatgaaaagatgttcaacatcactgatcatcagagaaatgcaaatcaaaactacaaggagatatcatttcaccccagttacaatggcttacctccaaaagacaggcaataatgaatgctggagaagatgtggagaggagggaacatttgtatgctgttggtgggaatgtaaattagtagagccactgtggagaacagtatggaggctcctcagacaactagaaatatagagaagtaccatatgatccagcaatcccattgctgggtatatg

SEQ ID NO: 29669 - DNA, 222 bp, Homo sapiens
  misc_feature 1, 2: n = A,T,C or G
nntcccacttgtgagtagagcagtttattttggactagttgaaaaaaattggagggagaagtgtatgtttcaacacccaagcttaagttttgatggcttatgtaatctagaaattcactttttgcagtggtagtatatataccctatcacaaagagcttttgtttgttttttgagatgaagtctcactccagcctgggcaatggagcgagactctgactcag

SEQ ID NO: 29670 - DNA, 267 bp, Homo sapiens
cgtggtggctcatgcctgtaatcccagcactttgggaggcccaggtggagggatcacttgaggtcaggagattgtggccaacgtggtgaaaccccgtctctactgaaaatacaaaaattagccaggcgtggtggcacattgcccgtaatcccagctactcaggcggctgaggcaggagaatcactggaacccgggaggtggaggttgcagtgagccaagatcgtgccactgcactccagcctggaaaacatagcaagactccatttc

SEQ ID NO: 29671 - DNA, 256 bp, Homo sapiens
  misc_feature 11: n = A,T,C or G
aaaataaaatnctcggtgttctatttatttattgtcttcctgtaagaccttcgggtcagggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagt

SEQ ID NO: 29672 - DNA, 162 bp, Homo sapiens
cacaaaatgagggaagtggggagttagatttcagagtccaggccctaggttgggacccactccaaataatctcctcggtgtgggtggtggttctatagagggataaatgaataataaacattgttaaaatatacgataatgaataaagtaatcctttcatct

SEQ ID NO: 29673 - DNA, 471 bp, Homo sapiens
  misc_feature 443, 452, 453: n = A,T,C or G
agagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactccggagttccaaagatgtcagagatatggatgacgcctatgacagactgacaaggcaccgctgcaggatggtccgaacgtggaatagctgcacaacctctttatgctggatattgtaaccatgagaacatgtaaaaaatggaggggaaaaaggccacagcaatctgtactacaatcaactttattttgaaatcatgtaaaataaganttagactgnnttttttgaataaaatatt

SEQ ID NO: 29674 - DNA, 120 bp, Homo sapiens
ggaaaactggagacagaagtacgggaaggcgaagaaaagaatagagaagatagggaaattagaagataaaaacatacttttagaagaaataagataaatttaaacctgaaaagtaggaag

SEQ ID NO: 29675 - DNA, 215 bp, Homo sapiens
  misc_feature 215: n = A,T,C or G
tatggccgggcatctactttaaaacaaagctgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtn

SEQ ID NO: 29676 - DNA, 251 bp, Homo sapiens
gggagtgttcttctctgtatggtatccttttatttgcttggctgggttcataacagtgtgtgccatattctttcttttcactgattctaagccatgagacttattagcatctggtggcaagctgcagggaccattaacagtgtgtctctttgactacaacgtggatctgccactacgcgctatgtaccattatgtacaatctctatttggctcaacttcgatgaaaaagaaataaatatttgctaaactct

SEQ ID NO: 29677 - DNA, 399 bp, Homo sapiens
gatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatga

SEQ ID NO: 29678 - DNA, 494 bp, Homo sapiens
  misc_feature 2, 14: n = A,T,C or G
cngggaattcggcnttatggccttttcatgatattgattcttcctatcctaagcatggaatgtttttccatttgtttgtgtcctctcttatttccttgaccagtggtttgtagttttccttgaagaggtccttcacatcccttgtaagttggattcctaggtattttattctgtttgtagcaattgtaatgggagttcactcatgatttggttctctattattggtgtgtaggaatgcttgtgatttttgcacactggttcaagcggacctaatacacacctacagaactctccaccccaaatccacggaatatacattcttctcagcaccacatcacacttattctaaaactgaccacataattggaagtaaaacactcctcaccaaatgcaaaggaatggaaattataagtctctcagaccacagtgcaatcaaattagaactcaggattaagaaactcactcaaaaccgcacaactacttggaaactgaac

SEQ ID NO: 29679 - DNA, 465 bp, Homo sapiens
aatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttattttttgtctttgtttaactttttaaaaaataggatttctggagtagattggtatattctgttaaagacttacagtgatccattttgcttacactgttgcatcacaagggactcacccagggaccatgacctgct

SEQ ID NO: 29680 - DNA, 223 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcttg

SEQ ID NO: 29681 - DNA, 120 bp, Homo sapiens
  misc_feature 7: n = A,T,C or G
gaatgcngaaatgaaatgatgagatgagatgatgaaatgaaatggtgagatgaaatgatgagatgaaatgaaatagtgaaatgaaattgaaataaaatcgaaatgagatgaaatgatgac

SEQ ID NO: 29682 - DNA, 466 bp, Homo sapiens
  misc_feature 12: n = A,T,C or G
atcataaaccgnaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttg

SEQ ID NO: 29683 - DNA, 470 bp, Homo sapiens
atggccggggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcagtgcttttagattaaaatgaaggtgacttaaacagcttaaagtttagtttaaaagttgtaggtgattaaaataatttggaaggcgatcttttaaaaagagatt

SEQ ID NO: 29684 - DNA, 271 bp, Homo sapiens
  misc_feature 185, 199, 219, 227, 252: n = A,T,C or G
ggaaaaggtgaatagatacaggcaaaggtggaagctattctaaaagcaaaaggccggaatgaaggaaggagagatatgagactcaagcaagtcaagagtcactgaaccaaattagagatagaagtagtgagatagcaagatattgagagagagagagagagagagagagagagagagagttttangcataaagattggnggtgttcaatgtttcttganggcgtggnggattatgtctgatatgaaatgatntcacttatacttaagaggt

SEQ ID NO: 29685 - DNA, 272 bp, Homo sapiens
  misc_feature 18: n = A,T,C or G
caaggacttcttcaagangaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcag

SEQ ID NO: 29686 - DNA, 391 bp, Homo sapiens
cagggaacccaggggaatcttgaggcccttgcatgtttgtagagtttcatttttagagcatcatattagaagtgggagttttttctctatataaaattcatgcatttcgctgggtgcagtggctcacgcctgtaatcccagcactttgggaggctgaggtgggcagatcacctgagctcgggagttcaagaccagcctggccaacatggtcaaaccctgtctctactaaaaatgcaaaaattagctgagcatggtggtatgtgcctgtaaatcccagctacttgggaggctgaggcaagaaaactgcttcaacctgggaggcagaggttgcagtgagccgagatcgcatcactgcactgcagcctgggcgatacagtgagactctgtctca

SEQ ID NO: 29687 - DNA, 352 bp, Homo sapiens
  misc_feature 350: n = A,T,C or G
atagttttgcaactcaacactgatctctgtcatagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacngc

SEQ ID NO: 29688 - DNA, 168 bp, Homo sapiens
  misc_feature 15: n = A,T,C or G
acaaaaagtaaaatngctgggcatggtggcacactactgtagtagttccagctacctgggaggctcaggttggggagggtcgcttgagcccaggaggtcgaggttgcagtgagctgtgatcgtaccactgcactccagcctgggcaacagagtaagaccctgtcttcc

SEQ ID NO: 29689 - DNA, 460 bp, Homo sapiens
catacatggaaactatagccttagctgctgaggtatgaataatccccacaacttggtatccaagaaagggttatttttctttttccaaaggcctaattgaacattttctgtggttctattgaggctgtgcaggctgattttgggtggcgtagaataaattcattgtgatgatgttggggagcacatgctgcacaaaagtggtgattggtatttgtacaatctaagtctttgattaatgagaaatagaatgtgaattattaagtcagtaaatgcagtcttttcaatagtcaaaatattttttaaatattaaatctctggggaataaagaaaaaacataatccaggttcagaatcctttatctaaaacccctggggccagacatgttttggaattcagaaatttggagaggagggttagaaaagaactaggatgccaagattatatattacataacttcctc

SEQ ID NO: 29690 - DNA, 427 bp, Homo sapiens
atggccggggggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagtga

SEQ ID NO: 29691 - DNA, 467 bp, Homo sapiens
gggagaagaggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacac

SEQ ID NO: 29692 - DNA, 467 bp, Homo sapiens
  misc_feature 244: n = A,T,C or G
tcattatgttgtgatttctgctacaggatgatcttttaaatcttaatttctttctgggcgtgagccaccatgcctagcctttatgtatatttcttaaattttaaatttctcaaagggtgtccattccctgctgctaatattttcttcactatagatgtctttgtgagaaggtttggtacttttcaaaacctgttggtcttagaaagaagaaggtaagaattgtgaaaagctgattgcgactggngcccttgtaggtcaataatgtctattttgatgtggcctgaatatttcacttcattttatatggtcggatgctccatgttaggattaaggggtaattaataggtaatgtatgtggaattcagtgtgagttgattcattcatctgattctgtatttaatatctaaatgggatcagtgacactggtaggatgggtgagagaagaaaattggctaaaattgcatcat

SEQ ID NO: 29693 - DNA, 259 bp, Homo sapiens
ggagggtcctctttttatgttgagttgctgcttcccggcatgccttcattttgctatggggggcaggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgcaaat

SEQ ID NO: 29694 - DNA, 314 bp, Homo sapiens
aattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcatcca

SEQ ID NO: 29695 - DNA, 208 bp, Homo sapiens
  misc_feature 8, 22, 25, 27, 29, 30, 31, 35, 38, 39, 46, 56, 57, 58, 59,63, 65, 70, 80, 101, 118, 135, 138, 202: n = A,T,C or G
gggaggcngagctgacagattnctngncnnnatgnctnnctgccancctttacctnnnntcgngntcttntctctttctngcctggaggctatccaatcgnactccaaagattcaggnttactcacgtcatccancanagaatggaaagtcaaatttcctgaattgctatgtgtctgggtttcatccatccgacattgaagntgactt

SEQ ID NO: 29696 - DNA, 100 bp, Homo sapiens
gcagttttgaaaagtaagaggcagaattaacaatattttggtgaacttctgcatatttgccacaacttagtcttttgatttgtcaagagtttttgaaact

SEQ ID NO: 29697 - DNA, 219 bp, Homo sapiens
  misc_feature 113: n = A,T,C or G
gacctcgttgcactgctgagagcaagatgggtcaccagcagctgtactggagccacccgcgaaaattcggccagggttctcgctcttgtcgtgtctgttcaaaccggcacggnctgatccggaaatatggcctcaatatgtgccgccagtgtttccgtcagtacgcgaaggatatcggtttcattaagttggactaaatgctcttgcttcagaggatta

SEQ ID NO: 29698 - DNA, 160 bp, Homo sapiens
  misc_feature 160: n = A,T,C or G
cgactcttagcggtggatactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccn

SEQ ID NO: 29699 - DNA, 269 bp, Homo sapiens
gacgaggcagctgggccacatttgctatgcccagatcctctgtgacctaacagcaatgttaggaactattcccgaaagtgataaacacaatttcagtttattagtgctcctctcattaacccattgtttttttctttctttctttctttctttaattttttgattaaaatggaacaagctgggcgcagtggaatgggaggttgaagttgtggtgacccatgattgtgccattgccctccagcgtaggggacagaagaagacatcatccc

SEQ ID NO: 29700 - DNA, 263 bp, Homo sapiens
attacaagaaggtggcccggaccatcggcatttctgtggatccgaggaggcggaacaagtccacggagtccctgcagaccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagag

SEQ ID NO: 29701 - DNA, 109 bp, Homo sapiens
  misc_feature 1, 3: n = A,T,C or G
nantcggccttaggccgggggaagggctctataatgggatcattgcatttctctgattactaatgagagtgagtactccttcatatgtttagtagatatttgaattgta

SEQ ID NO: 29702 - DNA, 245 bp, Homo sapiens
  misc_feature 6, 228: n = A,T,C or G
atttcntaaataccctacgtactggcatatttgaaactctttttccaggttaggtccttttctttctcattgaatcatcttaaatagttcttggccctgaatttagctgatttaaaattcttaatattcaagaatttatacttattttttccttaaaagccacaggggacagttaaatatcttaaaatatctaaaacattttttaaagcacttagattggcttacgtntgtgcatactatacctt

SEQ ID NO: 29703 - DNA, 250 bp, Homo sapiens
  misc_feature 140, 172, 198, 207: n = A,T,C or G
gaccgtctatgtagcaaaatagtgggaagatttataggtagaggcgacaaacctaccgagcctggtgatagctagttgtccaagatagaatcttagttcaactttaaatttgcccacagaaccctctaaatccccttgtnaatttaactgttagtccaaagaggaacagctntttggacactaggaaaaaaccttgtngagagagtnaaaaatttaacacccatagtaggcctaaaagcagccaccaatt

SEQ ID NO: 29704 - DNA, 333 bp, Homo sapiens
  misc_feature 160, 310, 327: n = A,T,C or G
gaaagattatttagagatctaggtactgtggcttgtaatcccagccatcccagaggctgaggtggaaggattgccggatggcagatttggaggctgaggaaggatagctggagattaagagttggagaccagtctgggcaacataggaagaccccatctnttaaaacaaaacaaaacaaaacaaaacaagtgttgcgtgtgtctgtagtcctacctacttgggaggctgaggctggaggatcacttaggcccaggagtttgagattgcagtgagctgtgattaaaccactgcactctagcatgggtggtngagcaagaccttgtttntttacc

SEQ ID NO: 29705 - DNA, 391 bp, Homo sapiens
  misc_feature 320, 367: n = A,T,C or G
tggccctctatttatttttttataagaattaaaatgttagaaatgactttcgaggtgggctgtttcccttcaagttattatttaagcagtagatgaagttaccattaatgtaaagtcctggttttaaagaactagttactgattccatttggaaattatttttatgaggattttcagacatttgaacattttcaactggcactgaaagttgaatactgcttttagaataacaacagaaaatcaaagcctgtatgttccttttcccttttacttgttaagcaaatcttgaagaagttacttgactcattgttctgaatgtnttaatcagtcactttaattttttgaaagaatttccttgaaagtgttnttaaataaaaatagggatcttcct

SEQ ID NO: 29706 - DNA, 274 bp, Homo sapiens
  misc_feature 143, 173, 181, 213, 219, 237, 253: n = A,T,C or G
ggtattaagaaattatctgcaccactgacgtcattaacatttcttgtgacattacaagatttcacttgtaatcactaattctttgtagatgcacctaagccatttatctgtacaggccatttatctgtatttttttttttaanacggagtctcgctctcgtccaagctggagngcaggggngcaatctcggctccctgcaacctccgcctccngggttnaagcgattctcctgcctnagcctcctgagtagcngggactacaggcacccaccac

SEQ ID NO: 29707 - DNA, 108 bp, Homo sapiens
atggaaaatttgaagttttggtcatattttggctgggcatgtggctcacgcctataatcccagcactttgggaggtcaaggcgggcagatcacctgaggtggggaggg

SEQ ID NO: 29708 - DNA, 101 bp, Homo sapiens
tcctctctggagtttatcccagaaaacctccagtctgaagtttccccactcattaaatgtctgattaggccaaggatttaggtcttagagattaataataa

SEQ ID NO: 29709 - DNA, 148 bp, Homo sapiens
  misc_feature 146: n = A,T,C or G
gatgtgtgttattccccttcttgtgtccacgtattctcatttttcagctcccacttatgagtgagaacatgcagtgtttggttttctgttagtttaatgcccttgtttcttaagcttttctttggattgcttaatatgttgatgtnta

SEQ ID NO: 29710 - DNA, 148 bp, Homo sapiens
gactcctctggatgacccgtccccaaagttgacattccatttcatgttccactgtgattaattcttttcttttttaaaaaatcattttaaagttttttgtttaattataaagtagtacatgtacattataaaaaaaaagttcaactag

SEQ ID NO: 29711 - DNA, 431 bp, Homo sapiens
  misc_feature 26, 387, 417, 427, 429: n = A,T,C or G
gggaggaaggagataaactgaaactnacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttntataatttgaaaaaataaataaacattatnttttttgtgnangc

SEQ ID NO: 29712 - DNA, 101 bp, Homo sapiens
  misc_feature 72, 87: n = A,T,C or G
gtataataggttatctgtgtccctcatcttggtgttacagtgttatttctgtcagtattatgaatatgtggntgacccatcctgtcnaatgtaccaacgtt

SEQ ID NO: 29713 - DNA, 419 bp, Homo sapiens
aactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttattt

SEQ ID NO: 29714 - DNA, 101 bp, Homo sapiens
  misc_feature 48: n = A,T,C or G
gcaggaggcagaagaatggtacaaatccagtttgctgacctctctgangctgccaaccggaacaatgacgccctgcgccaggcaaagcaggagtccactga

SEQ ID NO: 29715 - DNA, 252 bp, Homo sapiens
  misc_feature 240: n = A,T,C or G
ctcccaaagtgctgggattacaggtgccagcaactgtgcccagctgagaaaagatatctcaatgccatatcttttcaagatagagagaaaagtgaatgtgtatagaatgcttccctttgtttgctgaatgctcttgtgcttattctctgagttgttaatcttcagtgaaatagtttgtgttattagagatgacttgttaataacagagttctttctagattccagaatttttctgggatncatgaagacttt

SEQ ID NO: 29716 - DNA, 489 bp, Homo sapiens
  misc_feature 28: n = A,T,C or G
ctcttgagtgctggacttaggccaagcnccgtggcccgataattttgtttttttgatataagttttgtagagatgaggtctcactatgttgccctggatgggattctctggctcttaataaataattgctttttaaatctttcacaaaggaaaccttgagtgagtgaataatcaaaaggtgatagattgtttagtttctattttctgtggcatgaaggtcagtgatgctcaggatgggtgtgagtaagatgcttgtgctaagcatgctccctgccccacagtcagtctgcatgagccactgtttctaataagactgtggatagagtgatataatcacctctaaccatatcaaatgttacacgtaagtttcagattttgagacatgagttgataagatttgaagttcaaagaccatgactttagtacttcctgagtaatcaactgaaatatgttttacatatgtgttttccaaattgctgaccattcatt

SEQ ID NO: 29717 - DNA, 206 bp, Homo sapiens
gggcgtagccatggcggctaacgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaagga

SEQ ID NO: 29718 - DNA, 100 bp, Homo sapiens
  misc_feature 5, 89: n = A,T,C or G
gaccncgcttttcatctgtcccgctgcgtgttttcctcttgatcgggaactcctgcttctccttgcctcgaaatggaccccaactgctnctgctcagcct

SEQ ID NO: 29719 - DNA, 101 bp, Homo sapiens
  misc_feature 89: n = A,T,C or G
tgttattattttttctttctatatactctccttgcagaaaggaactaggggctctcacattctccaggaatttcctgatttacaacatnttcctactacaa

SEQ ID NO: 29720 - DNA, 314 bp, Homo sapiens
  misc_feature 218, 303: n = A,T,C or G
gacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcangagcattgtgcaatacagtttcattaactccttcccccgctcccccaaaaatttgaatttttttttcaacactcttacacctgtnatggaaaatgt

SEQ ID NO: 29721 - DNA, 125 bp, Homo sapiens
  misc_feature 107: n = A,T,C or G
gaaggtgccttccaatggaaatgcgaagtagttgctatagcaagaattgggaactgggatataagtcataatattaattatgctggtatggaaatgatggggtggtnacattccttaagggaaat

SEQ ID NO: 29722 - DNA, 378 bp, Homo sapiens
gaaataatgaccttgatttttgggtgtgtattgcagaagcctcgtcgctttcaagtcacatcatatatgcgatctggcctaactatggagatattggttatcagtttgcagatgaatacacagttctatccaacagaaactgtatctttcagtttgtcagaagttctccgttagttcctgtattagtcaaggttttccagagaaacagaatcaatatatattggggcaggggggcggtggttattataaggaattggctcacgtgattatggaggcggttaaatcccaagatctgcaggataagtcagcaagatggagtcccatgagagctgatggtttagttccagtctgatggcagcaggcttgacgccaaggaag

SEQ ID NO: 29723 - DNA, 250 bp, Homo sapiens
  misc_feature 250: n = A,T,C or G
ctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggacttctctctttcttcaccaagaagcacagaattctgctn

SEQ ID NO: 29724 - DNA, 158 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttg

SEQ ID NO: 29725 - DNA, 205 bp, Homo sapiens
  misc_feature 109, 115, 149, 151, 170, 204: n = A,T,C or G
gttagaggaaggagaaaagatccaacacatgtaccgctgtgctcgagtccagggcctagataccagtgaggggctccttctttttggtaaagagcatttttatgtgatngatggntttaccatgacagcaaccagggaaataagagatntngaaaccttacctgcaaatntgcatgagcctattattcctagaggagccaggcna

SEQ ID NO: 29726 - DNA, 151 bp, Homo sapiens
  misc_feature 145: n = A,T,C or G
ctccccagctgtgaaaggaggagctctacggtgactttgaagacttggaaacaggggacatgcacaagggaaaatcgggccccgacactcagaatgaagatatagagaaacaaggaagaaattgaccccgacgaagtaagaaagngccaag

SEQ ID NO: 29727 - DNA, 107 bp, Homo sapiens
  misc_feature 106, 107: n = A,T,C or G
cgcaggaactgtgtgtgtcctacacaatggtgctattctgtgtcaaacacctctgtattttttaaaacatcaattgatattaaaaatgaaaagattattggaaagnn

SEQ ID NO: 29728 - DNA, 470 bp, Homo sapiens
  misc_feature 3, 5, 17, 21, 29, 32, 51, 61, 63, 113: n = A,T,C or G
ggnancaggaggaggcngagnacagcatngtngggaccagactcgtctcangccagttgcngncttctcagccaaacgccgaccaaggaaaactcactaccatgagaattgcngtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtct

SEQ ID NO: 29729 - DNA, 470 bp, Homo sapiens
  misc_feature 30: n = A,T,C or G
gaaagacctctttcgcaagaaacctgcccnaaaagtgaaagcgaagaagaaacacactaacgcagaaaaaaagttggcagacagggaaagcgctctagcgagtgctgatttagaagaagaaattcaccagcaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaggaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgttt

SEQ ID NO: 29730 - DNA, 167 bp, Homo sapiens
  misc_feature 15: n = A,T,C or G
agctgccttaaagtngtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactcc

SEQ ID NO: 29731 - DNA, 470 bp, Homo sapiens
  misc_feature 180: n = A,T,C or G
ggggcattcctgaagctgacagcattcgggccgagatgtctcgctccgtggccttagctgtgctcacgctactctctctttctggcctggaggctatccagcgtactccaaagattcaggtttactcacgtcatccagcagagaatggaaagtcaaatttcctgaattgctatgtgtctngggtttcatccatccgacattgaagttgacctactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaat

SEQ ID NO: 29732 - DNA, 412 bp, Homo sapiens
ggacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatga

SEQ ID NO: 29733 - DNA, 289 bp, Homo sapiens
  misc_feature 6: n = A,T,C or G
atcagnaaacctgaagggcagaaggtagtgtgatgatacatcttaactgatgaaagaaaaaactgtcaatcaaaaattttatatttagaaaatcctatcctttgagagaagaagaaattcagatatttccagataaacaaaagtcaaggtagtttttcactaatagacctgccataaaaatattttaagtgagttcttcatgcagaagtaaaagtatatagtacctcaaagccatatgaagaaataaagatcactgataaaggcaacctcattaataaatagaaaaccc

SEQ ID NO: 29734 - DNA, 461 bp, Homo sapiens
  misc_feature 6, 7, 30: n = A,T,C or G
tcggcnnttattggccgggagtgtaactanttttgtacaatagaggactgtaactacctactttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgttttctgtgcatgttctctacacaattgtaaggtgtcactgtatttaactgttgcacttgtcaactttcaataaagcatataaatgc

SEQ ID NO: 29735 - DNA, 341 bp, Homo sapiens
gggcagtcaggggcaaggactgttggaggagagttagcccaagtataggctctgtccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgat

SEQ ID NO: 29736 - DNA, 275 bp, Homo sapiens
tgtggtggctcatgcctgtaatcctagcactttgggaggctgaggcaggtggatcatctgaggtcaagagtttgagaccagcctgatcaacatggtgaaaccccgtctctactaaaaacataaaaattagccgggcatggtggcagatgcctgtaatcccagctacttgagaggctgaggcaggagaattgcttgaatccaggaggcagaggttgcagtgagccgagactgcaccattgcactccagcccgggtgacagagtgagactctgtctc

SEQ ID NO: 29737 - DNA, 471 bp, Homo sapiens
  misc_feature 1, 14, 73, 263, 330, 344, 359: n = A,T,C or G
natctgcctgtgtncatgaatctcagactgtgttcactttccaccacatttaaatagtaattgtgaatttgtnatgcccaaacaagtggtctaaacactctggaatcagtggtagttcaaccagaggcttggttaagaggagcagtgttccaggtggaagaaaggcccacatgcctgaaggctacatggggtcctgtgcgttctgactccagtctacaacagactagatgaagatttgacagaccccatgtgataactgatcnctctgcaatgtcctgattaaatctgtcgttctgtttctgtttaaatccaccacaatatttgtggatnaaaatagattgtgnctgatgtgacaccgngtgcaaccagagaaaaaaatagattatacttttcaaaataaaaaagcttttgtgcttcaagggacattatcagagggaaaagacaacctggagaatgggagatatattttgc

SEQ ID NO: 29738 - DNA, 246 bp, Homo sapiens
catcctcatcctagcaataatccccatcctccatatatccaaacaacaaagcataatatttcgcccactaagccaatcactttattgactcctagccgcagacctcctcattctaacctgaatcggaggacaaccagtaagctacccttttaccatcattggacaagtagcatccgtactatacttcacaacaatcctaatcctaataccaactatctccctaattgaaaacaaaatactcaaatg

SEQ ID NO: 29739 - DNA, 105 bp, Homo sapiens
acagtgtggccgagcagatggctatgtgctagagggcaaagagttggagttctatcttaggaaaatcaaggcccgcaaaggcaaataaatccttgttttgtcttc

SEQ ID NO: 29740 - DNA, 488 bp, Homo sapiens
  misc_feature 1, 2, 292, 401, 465: n = A,T,C or G
nntctagtgttcctcatgtgttctaaagtctttttgtaaaataaacacaaaaatagatttatgttgaattggcactttctatatctgaaattgtattatctatttttatttaacctttcttatattatctgaagatgaatatgtatgtggctgtattttgtatatatttaagttttaagtgacacttggatttctgatcagtgttgcaaaaaattgctactttgagatttatttccacagtgttatattaaacccaaaaggaatcatcatatttggatgcttaaaatagagnatacaagttttttagacccaaagaaaaaaacagcagagtctaagcatgatcagtcctgattgaatttcattatgtcacagtgatgcatgtcttagcactgattattggntttacttaatattccctaaaaacttgaggaaggaagatgatagaacatgagatactctttgttntgtacatactagaaaatacagct

SEQ ID NO: 29741 - DNA, 353 bp, Homo sapiens
  misc_feature 6, 7: n = A,T,C or G
tcggcnntttattggccggggaaatggaagaggaaatgcatcgaacgtcaataagcacattcaagaaactgaatggcagagtcaagagggtaaaactggcctagaagctatcagcaaccacaaagagacagaagaaaagactgtttctgaggctctgctcatggaacctactggtgatggtaataccacgcccagaaatcatggagttgatgatgatggcgatgatgatggcgatgatggcggcactgatggccccaggcacagtgcaagtgatgactactccatcccaagccaggcctttctggaggccgagagagctcaatccattgcctatcacctcaaaattgaggagc

SEQ ID NO: 29742 - DNA, 472 bp, Homo sapiens
  misc_feature 8: n = A,T,C or G
ggaaaganggcggcggcagtactgggacagttgggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcgggacgaggccagtgcctgaaacgcatccgctaccatggcagag

SEQ ID NO: 29743 - DNA, 240 bp, Homo sapiens
agtgacagctaggatgtgtattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatg

SEQ ID NO: 29744 - DNA, 475 bp, Homo sapiens
gaggcattgaggcagccagcgcaggggcttctgctgagggggcaggcggagcttgaggaaaccgcagataagttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtgatt

SEQ ID NO: 29745 - DNA, 394 bp, Homo sapiens
  misc_feature 5, 6: n = A,T,C or G
cggcnntttattggccggggtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattggggagggcacctgtgctggttgcacttgctttgattgaatgtggaatgaagtacgaagatgcagttcagtttataaga

SEQ ID NO: 29746 - DNA, 100 bp, Homo sapiens
  misc_feature 13, 17, 64, 65, 79, 91: n = A,T,C or G
gcttccagatggntcgnaagcctcttagcgagagactgggccgccgacactaagaaacatctannggtgccgggggatncaatccctacgntcacaggat

SEQ ID NO: 29747 - DNA, 230 bp, Homo sapiens
  misc_feature 2, 28, 41, 50, 56, 81, 82, 124: n = A,T,C or G
tntggcccggggtttcaaataaatgaanctcaatctaaatnaaaaaaganggaagntttgaaaaaacctttctctttgccnntttcttcttcttcttttttaactgaaagctgaatccttccantttcttctgcacatctacttgcttaaattgtgggcaaaagagaaaaagaaggattgatcagagcattgtgcaatacagtttcattaactccttcccccgctccccc

SEQ ID NO: 29748 - DNA, 143 bp, Homo sapiens
  misc_feature 10, 11: n = A,T,C or G
aaactcggcnntttatggcccgggagaaaagaaaggtaaaagtagcccttagtgtagccctgtaagtcattccatcaaggatcttttcctttctttatccaatctcttgaccaagttccaagtgattataccgttctagtttg

SEQ ID NO: 29749 - DNA, 240 bp, Homo sapiens
ctgattttagaggaaaagctttcagtttttcaccaacgagtatgatgttgccgtaggctttacgtatatggttttgacatgttcaggtaaagtatttactaagtattttcatcaagaaaggttgtagaattttgtccagtgctttttctgtgtctattgagatggtcatggtattttatcttttaatctgttttattgtgtattgcactaattgatttgctttttttcaatcatccttgt

SEQ ID NO: 29750 - DNA, 192 bp, Homo sapiens
ctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgacc

SEQ ID NO: 29751 - DNA, 473 bp, Homo sapiens
agagaggaagaagcagtttttgttgtcaccgcaaagactgaagtttcttctatatgtgatgattaggtaatattgggaaaaaattatacccaaaatgcatcatgtgaaatgactttttctcctagtagtttacattttcaattcaacaaatattaattgaacaccctctgttgtaaccagagtaataaaaagacagctaggtcccttcttgtaacaaacttagattattatctcataaaaggcattaaaaaaacaaatttgtctctagaatgttccagtggaaaacttctttgtgaaatgcaatggagcactcattaacaccagtgacacagtgcagcatggagctgtttataggttttggaacccagactttgcggtggaaaaggaggtaggacctgaacattgactactttagttgtaacacatttgcagtctttattcatttattttcatattctgcagtgagccgagat

SEQ ID NO: 29752 - DNA, 111 bp, Homo sapiens
  misc_feature 4: n = A,T,C or G
aganctcatggggcctgcagcgaatttacaggaaaggaacccatgagggaagttgggctgacatgtcttcacatttccttccgcacatgctcaatgttataaacagtgtgt

SEQ ID NO: 29753 - DNA, 325 bp, Homo sapiens
gacacgccttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacttcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttt

SEQ ID NO: 29754 - DNA, 470 bp, Homo sapiens
ggtgatttggcgcggcctttgtttctcgctgccgccgaagctccaattttcgtctgtctgctttgtgtcctctgcacgtagaagcccagcctgtgtggccctgcgacctgcgggtattgggagatccacagctaagacgccagggccccctggaagcctagaaatgggagcgttgacatttagagatgtggccatagaattctctctggaggagtggcaatgtctggacactgaacaacagaatttatatagaaatgtaatgttagataactacagaaacctggtcttcctgggtattgctgtctcaaagccagacctgatcacctgtctggagcaagaaaaagagccttggaatttgaagacacatgatatggtagccaaacccccagttatatgttctcatattgcccaagacctttggccagagcaaggcataaaagattatttccaagaagtcatactgagacaat

SEQ ID NO: 29755 - DNA, 238 bp, Homo sapiens
  misc_feature 17: n = A,T,C or G
ggtgctataggtgaccntctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattc

SEQ ID NO: 29756 - DNA, 156 bp, Homo sapiens
  misc_feature 66: n = A,T,C or G
aagccgaccgaggtgaatcagtatcctcattaagtggctggattctggtgcccggaacccaccggnggtctcaaagatgtagaacgcagcgtgtgcccacgctcagcaggtgtgccatccttccacctgctggggcaccagttcttagtatacaga

SEQ ID NO: 29757 - DNA, 472 bp, Homo sapiens
atcttcaaaactttttttatcttctgcaatgaaaactatgtacccatttaataataattcctaattacccctaccctctgcccgtagccaccaccattctactttgtgtctctatgaatttaactactgtcagtaccttatgtaagtggattagcgccaaatttgtctttttgcgattggcttagtcacttagcatcatgtcttccaggttcagtcatattgcggcatatgtcaggattttcttccctttagggtaacacttattgagctcttactgcctaccaggccttgtgctatgcgcttcaacagacctcacaatcaccctatgaggtagggagtctcactaactccatttcacagatgaagaaactgaagacaggaatgtttagaaagctgcctgatatggtttagcctctgtgtccccacccaaaactcatgttgaattgtaattcccagtgttgggggggaggga

SEQ ID NO: 29758 - DNA, 431 bp, Homo sapiens
  misc_feature 1, 12, 24, 39, 47, 57, 66, 86: n = A,T,C or G
nagtaaaaccanttgctaaagacntcgcacctagaagcncactgcantgtttttacntacctaccntctactggacctcacagaanttctttgggttctttgtaatttaactgaactaggtctgaaaacttatgaccaatacttgttataacttaaaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtgggaatggtctctcc

SEQ ID NO: 29759 - DNA, 444 bp, Homo sapiens
caggctcaagggatcttcccgcctcagcctcctgaatagctgggactataggcatgtgccaccatgtctggctaatttttaaaaatatttgtagagaagcgatctcactgtgttgcccaggctggtctccaactcctgggctcaagcgatcttcccaccttagcctcccaaagtgggattataggtgtgagccaccgtgcctggtgtttacacagtttcttcattagcaaaagacataactaatcttttccctctagggtaacttaagcaaaatgagagaattttctagcaaattgcaaatgttcagaagtcattctgagacagtacatttaactctttaacagatatttatagagcaataaatatcactgcaatgatattgcagtgagccaagatggtgccacagcactccagcctaggcaacaggagcgaaactcagtctcg

SEQ ID NO: 29760 - DNA, 425 bp, Homo sapiens
gggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgt

SEQ ID NO: 29761 - DNA, 339 bp, Homo sapiens
ccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggga

SEQ ID NO: 29762 - DNA, 162 bp, Homo sapiens
  misc_feature 67, 99, 128: n = A,T,C or G
cacttgaaatttttctaagatgacaaagtccataggacagagtaccatatttgtctggtctgttgtntcctccttagcccagtgccagacacctggtangtgggcaagagaaactcaatgaataaatnatatgaaggcaagttcagtggctcaactgaaatg

SEQ ID NO: 29763 - DNA, 191 bp, Homo sapiens
  misc_feature 6, 9, 14, 23, 24, 27, 41, 48, 52, 54, 66, 83, 104, 105, 130,165, 166: n = A,T,C or G
aatctnaantaatncactgctgnngcncatttgccctttanctgtatncatntnctactaaggatnattgccactctatcttngtggtacatgaggactttgcnncttctcactgcctcattccctgacnttctctagactagatgtcagtgcctaaatatggtnntcgctcacttcaggcctcacccctc

SEQ ID NO: 29764 - DNA, 135 bp, Homo sapiens
caagaaagggtggggacgcacatccgcgccaagagaagcgggaggagctgagcaacgtactggccgccatgaggaaagctgctgcgcaagaaagactgagcccctcccctgccctctccctgaaataaagaacag

SEQ ID NO: 29765 - DNA, 468 bp, Homo sapiens
gcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaag

SEQ ID NO: 29766 - DNA, 307 bp, Homo sapiens
aggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattg

SEQ ID NO: 29767 - DNA, 463 bp, Homo sapiens
  misc_feature 18, 19, 57, 66, 100, 103, 148, 155, 185, 199, 234, 239, 287,310, 331, 460: n = A,T,C or G
ggagtcagttccgcggtnnaggtgacctgactctctgaggctcattttgcagtatgntgaaattgnccccgcagttttcaatcatgtctgaaccaatctnagnccttgtgactggagcagctggtcaaattgcatattcactgctgtncagcatnggaaatggatctgtctttggtaaagatcancctataattcttgngctgttggatatcacccccatgatgggtgtcctgnacggngtcctaatggaactgcaagactgtgcccttcccctcctgaaagatgtnatcgcaacagataaagaagacgntgccttcaaagacctggatgnggccattcttgtgggctccatgccaagaagggaaggcatggagagaaaagatttactgaaagcaaatgtgaaaatcttcaaatcccagggtgcagccttagataaatacgccaagaagtcagttaaggntat

SEQ ID NO: 29768 - DNA, 344 bp, Homo sapiens
gaaatgaaatgaaataatgaaatgaaattgaaataaaattgaaatgagatgatatgataagatgagatgatgaaataaaatgatgaaatgatgagatgtgatgagatgaaatgatgagatgagatgacatgaaataatgaaatgaaataatgacatgaaattgaaatgagatgagaagatatgagatgagatgaaatgatgaaatgataagatgaaaagagttgatgagatgatgagataaaatgatgagatgaaaagatgagatgaaatgatgagatgaaaagatgagatgaaatgatgagatgaaatgggatgaaatgaaattagacgaaatgtaatgagat

SEQ ID NO: 29769 - DNA, 470 bp, Homo sapiens
catctgcctgtgttcatgaatctcagactgtgttcactttccaccacatttaaatagtaattgtgaatttgtaatgcccaaacaagtggtctaaacactctggaatcagtggtagttcaaccagaggcttggttaagaggagcagtgttccaggtggaagaaaggcccacatgcctgaaggctacatggggtcctgtgcgttctgactccagtctacaacagactagatgaagatttgacagaccccatgtgataactgattctctgcaatgtcctgattaaatctgttgttctgtttctgtttaaatccaccacaatatttgtggattaaaatagattgtgttgatgtgacaccgtgtgcaaccagagaaaaaaatagattatacttttcaaaataaaaaagcttttgtgcttcaagggacattatcagagtgaaaagacaacctggagaatgggagatatattttgcg

SEQ ID NO: 29770 - DNA, 129 bp, Homo sapiens
taaggagaagcgccaggaacaaattgcgaagagacgcagactttcctctctgcgagcttctacttctaagtctgaatccagtcagaaataagattttttgagtaacaaataaataagatcagactctgc

SEQ ID NO: 29771 - DNA, 468 bp, Homo sapiens
ggcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttcta

SEQ ID NO: 29772 - DNA, 218 bp, Homo sapiens
  misc_feature 4: n = A,T,C or G
aganaagggtcttgcagtgtttcccaggctggtgcctgggctcaagcaatcctcccctctgaacctcctgagtatctgggactacagctgtgtaccaccacgtgcagctatttgggaggctgaggtgggagaattgcttgaacctgggaggcagaggttgcagtgagctgaaatcgagccattgcactgcatcctggcaacagagtgagactccatcc

SEQ ID NO: 29773 - DNA, 468 bp, Homo sapiens
attgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattgggag

SEQ ID NO: 29774 - DNA, 468 bp, Homo sapiens
gagataatttttagcttagggcctggtggctaggtcggttctctcctttccgtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttgggagatctctattgtaatctctattgggagatta

SEQ ID NO: 29775 - DNA, 420 bp, Homo sapiens
  misc_feature 419: n = A,T,C or G
ggagccgggatctggcactcccaggactcccggccggggtagctcttcactcctcagcgcgacgtcgtgtcgagttcccaaaaagctccgcaggggctgtagggaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaataggttgtgcctcatcagaaacaagctatggaacaaatgagagttccctgaatgaaaaaacactcaagggacttacttctatnc

SEQ ID NO: 29776 - DNA, 293 bp, Homo sapiens
  misc_feature 44, 98, 179: n = A,T,C or G
cactcggctccattatcttgacttctctcctgccctcttacgtngcatttcttcttttacaccactgttttacatgttgctcctccttagccattggntcctgttggcttttgttcttttacctgagttggaaatctgggaagacaattccaactcagtggtctgggcattctggtggngctgccaaccccagggcaggaagaacagtgagtgagatactgtgccattacctgcttctccagccttgaagcccaaagcagccaaataactctcaaatgacgatcacttttacc

SEQ ID NO: 29777 - DNA, 470 bp, Homo sapiens
acctaggacagatcttttaaattttgttcatcttttttccaactagtttcaaaatgcagagctgagtgttctattttacatataccaacatttgtatgcatgacttgttatttttatgctgttgttacctgtgtcctttatcattgtattctgaaaatccataatgacaagtgatcatgtcaggataactttggttcagttctgagcacatgagtacagatgtttaaaacatgtcagataaatgagataaaaagctgagttgatcagattagttaagagaaaaggccaggcacagtggtttatgcctgtaatcccagcactttgggagacagggatagggagggtcattgagcccaggagttcgagatcagcctggacaatatagtgagaccccatctctacaaaaaataaaaaattagctgggcatggcagaacgtgcctatagttccattacttgagaggctaatgcg

SEQ ID NO: 29778 - DNA, 376 bp, Homo sapiens
  misc_feature 371: n = A,T,C or G
gaaggaagaccaaattgaatgaaatctggccttggaattggctgtagattcttcctcctcgaattgttactgaaaaggagtcttaaaaattgaaaatgttagcagagcattttgtagtgttacaggctttgttaatttttcattgtagtacctgttgctggcagagtaacttttcagaattgtaagatttgatataaacctgaattcaaggtaaaatttagtcgttaaactgcacctgaggagattatgtccaaacagcctttatacgtattgcagtgtggaaacttgcaaatataactaggctaaatgtcaaatgccacacgttttaaacttggtaggatagcaaagagcccagttgtacaacaatagtngaaac

SEQ ID NO: 29779 - DNA, 468 bp, Homo sapiens
cagaaaggacaggagaaaacatattttgtgttagaccgaaatctgtgatcactggtagagacttttagtatcagttgacctcttgtctctgatcatctcctttgtcaaaatgacaacacttttttgcaattgagattggttcctctttcagacttggcttcaagatttgatctcttggggtcgtgctgtctttagcagtggaaactcaaaaaattacaaattcgtaaccctgaattgtagtccatttcccattaccaagtgtttagagtgccctagtggcaactgtaagtcaccttttatagtggaggtgttacctagctcacttttaaataaaattggaacagcttggcttttgtcaatgtagcaaaagatgattttttaaaaggtgggggggtggggcacaagtggtacacacctgtaatctcagtactttgaggctgagatgagaagatcacttgagaccaggag

SEQ ID NO: 29780 - DNA, 473 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaacaccaatagaagggcaatgcttttagattaaaatgaaggtgacttaaacagcttaaagtttagtttaaaagttgtagggtgattaaaataatttggaaggcgatcttttaaaaagagattaaaccgaaggt

SEQ ID NO: 29781 - DNA, 288 bp, Homo sapiens; identical to SEQ ID NO: 24046

SEQ ID NO: 29782 - DNA, 116 bp, Homo sapiens
gggtgacggggaatcagggttcgattccggatagggagcctgagaaacggctaccacatccaaggaaggcagcaggcgcgcaaattacccacccccgacccggggaggtagtgacg

SEQ ID NO: 29783 - DNA, 472 bp, Homo sapiens
  misc_feature 466: n = A,T,C or G
attcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaggcttcccagataagcagcccaggaagaaatgaaaactcctctgatgtgggtggggggggtccgccagctggggccctccctgtcgccagtgggcacttttttttttccaccctggctccttcanacacgt

SEQ ID NO: 29784 - DNA, 473 bp, Homo sapiens
aagactgagctgcagaatacccttcggaccctctctagcaaagtagaggacttgagcacgtgcaatgacttgatagctaagcatggcacagctctgcagcgttctctcagtgagctggagtccctgaagttgcctgctgagagcaatgaaaaggtcaaacaggtcaacgaacgagccacactctttaggataacatccaatgccatgatcaacgcctgcagagatttcctcatgttagcccagacccatagtaaaaaatggcaaaagtcactacagtatgaaagagaccagcgtatccgactggaagaaaccctcgagcagctggcgaagcagcataatcacctggagagggccttccgaggagccacggtgctgccggcaaacactcctggcaatgtgggttctggtaaagatcagtgctgctctggcaaaggggacatgagcgatgaagatgatgaaaatgaatttttttt

SEQ ID NO: 29785 - DNA, 326 bp, Homo sapiens
gaacccccttcgaccttgccgaaggggagtccgaactggtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatccga

SEQ ID NO: 29786 - DNA, 473 bp, Homo sapiens
  misc_feature 394: n = A,T,C or G
ggagactttggggctttcagttagtggaagagctgcggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcangagatcaaaacgtggagtacaaggggaccgtctggcacaaagactgcttcacctgtagtaaacttgcaagcaagtcatc

SEQ ID NO: 29787 - DNA, 224 bp, Homo sapiens
aggctgttcttgtgagattgaatggcagttattttagaggttttcttgggggcgaggggggcttaatttagacccagttgaggaaatttgtaaaattcggttgaaatgcgtaatattgtgtagtggcagtttctcttatattttgtctgacgctgctgaaatcatctcatattttttcatctttcacacttcttccatattctctatcagttaacctctatttg

SEQ ID NO: 29788 - DNA, 407 bp, Homo sapiens
aggaaataaagttaccaatagcactgcctttgctgttcattgatgacctgtgacatctgtgacctgtgacatctgtgacctgcatgacctgagatctctttctgtctctgcaatcaaatttccaaaattcagagataaagacatgttcctagaacttcatttcagctttcacaacccctataatttccatttgaaaagccagcccaaacacaaaattagtttcctacgccagagaacattatgattacagaggtttggaaaaggggaggaaggtgttgtataaacccttagttctggttattttttcccctttatttgaatgacagtgactttaaaataacatacaaataaaagtaaaaccagagttttgaaaattgagcaagttgtacatttgtcacactgaaaga

SEQ ID NO: 29789 - DNA, 456 bp, Homo sapiens
  misc_feature 31: n = A,T,C or G
gaggccttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaaga

SEQ ID NO: 29790 - DNA, 205 bp, Homo sapiens
  misc_feature 7, 31, 32: n = A,T,C or G
agaatgnaagtggtctgaccactgcccctcnnactcccagggactcattacagcccttcattaagcagaggctggcacggctacagctgtcaccagattttaccttcactgctggccttgctgcagaagtggctgctagatctctctcctttaccaccatgcaggaacagacttttggtgatgaggaggaagaacaaataatgga

SEQ ID NO: 29791 - DNA, 286 bp, Homo sapiens
  misc_feature 5, 30: n = A,T,C or G
ggacnttggtgccccagaaccaggaattcngcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttat

SEQ ID NO: 29792 - DNA, 430 bp, Homo sapiens
  misc_feature 29, 31, 32, 41, 44, 45, 85, 95, 188, 245, 273, 274, 295,323, 391: n = A,T,C or G
aaatcaataaacttcaacactctttatgntnncaacactgngtnntattctttgaatcctagcccatctgcagagccctgactgngctcaccagnaaaagataacctttctttctgaaatagtcaaatacgaaattagaaaagccctccctattttaactacctcaactgggcagaaacacagattgnattctatgagtcccagaagatgaaaaaaattttatacgttgataaaacttataaatntcattgattaatctcctggaagattggnntaaaaagaaaagtggaatgcnagaatttaaagaaatatttttaaagccncagattattttaatattggatatcaactgcttgtaaaggtgctcctctttcttcttgtcattgctggncaagattactaatatttgggaaggctttaaagacgcatg

SEQ ID NO: 29793 - DNA, 465 bp, Homo sapiens
  misc_feature 6, 28, 29: n = A,T,C or G
ggggcnttcctgagctgacagcattcgnnccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgcttttt

SEQ ID NO: 29794 - DNA, 460 bp, Homo sapiens
  misc_feature 6: n = A,T,C or G
aagctnaaaattgacatcatccccaacccttaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagaga

SEQ ID NO: 29795 - DNA, 473 bp, Homo sapiens
  misc_feature 7: n = A,T,C or G
taaaccncatggttttctaagacattgcatttaattaaagcatgcttttcaataacactagttaccttgaccaaactggagttactgcttcacataaaggactattacctgtcaagagacatttactctgctggatgaagaactgaggaagagtgtcatgacgttaattatttaaaggcacttttctgaaaacatgtctcaaatcctaatgattctgttctttgcctataaacattagcgatgccattctacacttttcactgaaatggttctaaaaatataggagggaaattttgatgtgtgataaaagttcaggacgatcacatttttctgcctgtgtacttttgcttagtattactttgaaaaaccagctggaatttttgaagcagcctccgttttgctaaagtcattttgtagggtgggcctaataatggcctggcacaggacctgaacatcgaaaacacctaaagaac

SEQ ID NO: 29796 - DNA, 478 bp, Homo sapiens
  misc_feature 7, 33: n = A,T,C or G
agctagnattctcaaatggaagtgttatatatnatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaattaaga

SEQ ID NO: 29797 - DNA, 461 bp, Homo sapiens
  misc_feature 6, 22: n = A,T,C or G
caactntaaatttgcccacagnaaccctctattccccttgtaaatttaactgttagtccaaagaggaacagctctttggacactaggaaaaaaccttgtagagagagtaaaaaatttaacacccatagtaggcctaaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttacc

SEQ ID NO: 29798 - DNA, 464 bp, Homo sapiens
aatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctg

SEQ ID NO: 29799 - DNA, 125 bp, Homo sapiens
  misc_feature 5: n = A,T,C or G
agggnagggaagcacaatggaaatacccctgaaccgttttattgcagtaatttttttcatatctgaaactattatttaatattttgaataagattttaaaaaataaatggcaaagatataaatct

SEQ ID NO: 29800 - DNA, 389 bp, Homo sapiens
  misc_feature 6, 24, 49: n = A,T,C or G
cggttnttatggcccggggttttnggttttgcttaagtgattttcaggnaaagctatattggttaaaaaaccatggtgggggccaacttgaagaaattagacatcagagaggtcaggcgtagtggctcatgcctgtaatcccagcactttgggaggccaaggcaggtgcatcacctgaggtcaggagtttgagaccagcctggccaatgtggtaaaaccctgtctctactaaaaatacaaaaattagccaggtgtggtggtgcacacctgtaatcccagctactcaggaggctgaggcaggagaatcacttgaacctgggaagtggaagttgcagtgagccaagattgtgccactgcactctggcctgggtgacagtgagacttggtct

SEQ ID NO: 29801 - DNA, 107 bp, Homo sapiens
  misc_feature 58: n = A,T,C or G
cgcaggcaactgtgtgtgtcctacacaatggtgctattctgtgtcaaacacctctgtnttttttaaaacatcaattgatattaaaaatgaaaagattattggaaagt

SEQ ID NO: 29802 - DNA, 378 bp, Homo sapiens
  misc_feature 6: n = A,T,C or G
ggtcanagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagttacaggccaaatttgagcaccttaagagacttcacca

SEQ ID NO: 29803 - DNA, 484 bp, Homo sapiens
  misc_feature 17, 33, 288: n = A,T,C or G
agtctcagtaacaaagnacattaaaagaaaacnatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgncattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgag

SEQ ID NO: 29804 - DNA, 343 bp, Homo sapiens
  misc_feature 30: n = A,T,C or G
gtttctctgttttcgtgaaagagctgaccntgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcacctgtgagtaataaactgtccatttctc

SEQ ID NO: 29805 - DNA, 358 bp, Homo sapiens
  misc_feature 6, 31, 33, 36: n = A,T,C or G
gacaanaacagggatacagagtattttaaantnatnagcaacaatgttttaatagctaagaatgacctttgtacccaaaaatagagaataaaccttcctttcaaatatttgtggattaatctcaataaattttaaaggcagaaattatgcatatctacttaatggccaaagtgcaattaataatagattaaataaaatccaatgggacatttttaaaaagaaaaaaatcaatgactttttgatcaaaaactagagagtaactatagttatagattagacacaagcctcttaatagtgtgtattttatttagccaaagttgtgctcaaagataaagtcatagtgttatctccttccact

SEQ ID NO: 29806 - DNA, 202 bp, Homo sapiens
ggctctgtgaaagcatattatttttctgataacttctccaacctaagctgagagccccatagatactaatctgaagttaataattaacataattaatatgtactatgcctaaatatacatctcccctcttccaaatgtttgattccaaactagcattttcaccagcctgggcaacatagcaagatcttatcgctacaatttt

SEQ ID NO: 29807 - DNA, 469 bp, Homo sapiens
  misc_feature 15: n = A,T,C or G
ctcctccccccaggnagaacttgaaaggaggttaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacacgacaaaaaccacacctaaagaaattttaagaatttggcacagttactcactttgtgtaatctgaaatctagctgctgaatacgctgaagtaaatcctt

SEQ ID NO: 29808 - DNA, 470 bp, Homo sapiens
  misc_feature 33, 187: n = A,T,C or G
atagcccacctgtggtctggcagaaacaacgtntctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaacntgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaat

SEQ ID NO: 29809 - DNA, 402 bp, Homo sapiens
  misc_feature 7, 16, 23: n = A,T,C or G
gataacntgtaacagnaaacagnaaaactacaggccaatattcctgataaacacagatgcaaaaatcctcaatgaaatactagcaaactgaatccaacagcacatcaaaaagatcacacaccatgcctaagtgggatttatcctaggaatggttcaacatatgcaaatcaataaaagtgattcatcatatcaacagaatgaagtacaaaatcatatgatcacccaaaagatgtagaaaaaatcatttgataaaatttaacatcccttcatgctaaatctctcaacaaattagacatagaaggaatatatctcaatacagttaaaggccatatatgacaaacccacagctaacattatactgaatggggaaaagttgaaagtttttcctttaaggaaaggaat

SEQ ID NO: 29810 - DNA, 110 bp, Homo sapiens
  misc_feature 109, 110: n = A,T,C or G
ctgaggtgggagagtcgcttgggcccagggggcgggaggttgaagtgagccgagatcactccactgcactccagcataggtgaaagagtgagaccccatttcaaaaccnn

SEQ ID NO: 29811 - DNA, 133 bp, Homo sapiens
  misc_feature 3, 8, 27, 45, 58, 79, 115: n = A,T,C or G
ggnaaccntatgaactggtgtaaattngtacagttcatgtatatngattgtggcaaanttgtacagatttctatatttnggatgagaaatttttcttctctctataataaatcgnttcttatcttggcatttt

SEQ ID NO: 29812 - DNA, 119 bp, Homo sapiens
  misc_feature 24, 105: n = A,T,C or G
tctcatgagatctgtgatggatgnctgtgtgcccggtgcaaaagaaatgcgtggacagcagaatgctgtctctgcaatttgagaggaggtgctcttaagcaaacnaagaacaataagtg

SEQ ID NO: 29813 - DNA, 262 bp, Homo sapiens
aagaccaaactcctctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttcg

SEQ ID NO: 29814 - DNA, 363 bp, Homo sapiens
  misc_feature 43, 44: n = A,T,C or G
tatggcccggggggaagcgagtcgagccagcgtcgccgcgttnntgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagc

SEQ ID NO: 29815 - DNA, 470 bp, Homo sapiens
  misc_feature 2, 29, 31, 32, 52, 57: n = A,T,C or G
gngttcggtgggaggtgtttgggtcctgntnntggatccctcatggcttggngctgnccatgatctcatggacagtgagtggggtctcacaaaatctggttgtttaaaagtgtggcatctccctcccctccactcgatctctcttgcgcctgctctggccatgtgacataaccgctcctgcttcaccttctgccatgagcaaaagctctctgaggcctccccagaagccaagcatattccagtatcaagcctcctgtccagcctgcagaaccatgagtcaattaaacctcttttctttataaattacccagtctcaagtattcctttatagcaatgcaagaatgttctcacacacctatttaggttaaaaggttttcttatcatcttggttttcagaaatggacaaattgccaagggcctgtcaattctggactgacattttttcacctgcttgaagagatactgttttc

SEQ ID NO: 29816 - DNA, 304 bp, Homo sapiens
  misc_feature 21, 28: n = A,T,C or G
agccctgcacttgcccttgcncacttgntctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccg

SEQ ID NO: 29817 - DNA, 110 bp, Homo sapiens
  misc_feature 14: n = A,T,C or G
gttaattgcttgtnaagctataaccacaaaaataatgaattgatgagaaatacaatgaagaggcaatgtccatctcaaaatactgcttttacaaaagcagaataaaagcg

SEQ ID NO: 29818 - DNA, 413 bp, Homo sapiens
  misc_feature 30, 31: n = A,T,C or G
gggacaggcttctcaaggcctgaccacttnngctgtcatgtaaaacatgtccattcaacagaaagacccttcaaatgccaaacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcagcagcagcagcaacaacaacaacaacaacatgtgacaagctggccagggaagcaagtagaaacactgagactgtgggaagaagctgttaaagc

SEQ ID NO: 29819 - DNA, 462 bp, Homo sapiens
  misc_feature 6, 30: n = A,T,C or G
gggacncattgtagaaaggaagccttgctntttcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcgctctaaactgcaaacagaaatcaggtgttttaagactgaatgttttatttatcaaaacgtagcttttggggagggag

SEQ ID NO: 29820 - DNA, 148 bp, Homo sapiens
  misc_feature 138: n = A,T,C or G
agatccaattctgtaatctcatttttctttgagctgatctcaagccaatggtctggggattttatagccaagggataattttgataatgggctattaaaacacttgcagctcctaccctgtctttcaaattagcgtgngcacagattg

SEQ ID NO: 29821 - DNA, 410 bp, Homo sapiens
  misc_feature 6, 30, 31: n = A,T,C or G
gaaaancttgagaatcatgttgaagctaanntcatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtg

SEQ ID NO: 29822 - DNA, 436 bp, Homo sapiens
atggccgggattgtccatagcgccaaaaaatgaatcttcttccccatcccaaagttactaaacatttagcaaagaaatcactcacataactgacaagtgaagttctgaagtctccattgtatcactttcagctttgactttaacataaacaaaaatgtcaaccaatattcatgttggaactaatcgtaagtttcatccattagtggctttggagtacagcagaaattaacaagttttctgtgagaatcaggtgactaatttacaatacacaacattgtatgttttatgatctttgtaaattttgtgttttgcattctttatatcagtaaaatttaaatttatatgtctggggtgtggtggtggctaggtcaggcaaggtttggtcccagcagctccatggctgctctgctctgagcatctggtatctactgtgcct

SEQ ID NO: 29823 - DNA, 253 bp, Homo sapiens
  misc_feature 2, 8, 13, 21, 24, 25, 38, 79, 104, 237: n = A,T,C or G
gnaaaaanaacanaaaggctnggnnaagaggagcaagngttccaggtggaaagaaaggcccacatgcctgaaggctacntggggtcctgtgcgttctgactccngtctacaacagactagatgaagatttgacagaccccatgtgataactgattctctgcaatgtcctgattaaatctgttgttctgtttctgtttaaatccaccacaatatttgtggattaaaatagattgtgtngatgcgacaccgtgtg

SEQ ID NO: 29824 - DNA, 220 bp, Homo sapiens
  misc_feature 1, 3, 5, 55, 95, 96, 121, 146, 173, 180, 190, 191: n = A,T,C or G
ngncnataaagtaaaggaacccgagaatttgcgcaggggttccctttgccgattnctctcacctcacctttcaaacctaaactcgagcctgctgnncaccggcctagcattgctctcgccntggctctcagcgatgctgacgtgcnaaagcagataaagcatatgatggcttncattgancaagaagccnntgagaaagcagaagaaatagatgcaaagg

SEQ ID NO: 29825 - DNA, 187 bp, Homo sapiens
  misc_feature 6, 14, 32, 133: n = A,T,C or G
aatttnacaacagnatttgctaatttaaaaanaaatgaaaaaaaaaatcttaccagcagtttgtaaaggtctggaatcactgttggcatcctttattcaggtctcttctctccaacgtacacttaaaattggngccgagcagggatataacctgcagttaagtgaaaagaaaatccagcctccccct

SEQ ID NO: 29826 - DNA, 149 bp, Homo sapiens
ggcctctgtctgtggagacggattacgccttcccacttgctgaaaaggtcaaggccttcttggctgatccatctgcctttgtggctgctgcccctgtggctgctgccaccacagctgctcctgctgctgctgcagccccagctaaggtt

SEQ ID NO: 29827 - DNA, 237 bp, Homo sapiens
  misc_feature 5, 8, 31: n = A,T,C or G
acagnaangaaggccagtcagctagtaggcntagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttg

SEQ ID NO: 29828 - DNA, 102 bp, Homo sapiens
  misc_feature 2, 12, 37, 41, 43, 50, 54, 55, 61, 81: n = A,T,C or G
cngcgtgtaggngaccacaccagaagcctcagctctnggtncntatcagnccgnncggganaggatccaggcatttctttnaaatctcagaggtagcagtaa

SEQ ID NO: 29829 - DNA, 172 bp, Homo sapiens
ggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccac

SEQ ID NO: 29830 - DNA, 463 bp, Homo sapiens
attttccaaatttccgtatttggcatgtacttgacatacagtcatctcttttcaatagttaacagaatgagtgatattgtctgggccagcagcccccaacgtttttgccaccagggaccagtttcatggaagacaatgtttccatggactggaggtgtggggatggtttcaggatgaaactgttccacctcagatcatcaggcattagattctcataaggagtgtgcagactcaatccctcgcatacacagttcacagtagggtttgtgctccaatgagaatctaatgctgctgctgatctgacagtaggcagagctcaggcagtaatgcttgcttgtccactgttcatctcctcccgtacagctaagttcctaacaggtaccagtgtctgaagcctggggactggcggctgctggtcaaggccacattagtttattgttaagtgcaaggtttctggtaacag

SEQ ID NO: 29831 - DNA, 472 bp, Homo sapiens
  misc_feature 15, 30: n = A,T,C or G
cggcaccattttttnggcaaactagtgatngacaggttggcttgaaaatcatgagactgttgttaaatcagatgctggttgatcacagaggggacttccagggaaagctgttatcaggtggctgcttcctggtgatgcagcctggctgatgagataaccctggctccacagatggcttagcaggtgctgtgatgatttggttttcttctcaattagactgagctgcacatggtgtttatattgcttggcacatggtaagggcttaatatttgaggtaattatgtagggcgtacactgacaagtatctgacccccccttcctttttgactcataaattggtcatcttaaccatttaagtgtacacttctatagtgacagagttagccctctgtccaagggatttgcatctgtggattcaaccaactttgggtcaaaaataatcaaaaaggatggttgtgtgtgtattgaacat

SEQ ID NO: 29832 - DNA, 481 bp, Homo sapiens
  misc_feature 34: n = A,T,C or G
ggaatcgtcacctggaaagaacaattttaagtcnatgtcatttctagatgggtttctaattctgcagagacacccgtttcagccacatctaaaagagcacagtttatgtggtgcggaattaaacttccccatcctgcagattatgtggaaatacccaaagataatagtgcatagctcctttcagcctctagccttcactcctgggctccaaaagctatcccagttgcctgtttttcaaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgat

SEQ ID NO: 29833 - DNA, 210 bp, Homo sapiens
  misc_feature 42, 177, 191: n = A,T,C or G
tatggccgggatctatctagttaattaaagttaaagtttttnctgatcaactactcaaactactaaatacatttacctgagaaaaagtctctgagagcacttcattcctgttttagttcgtgtaaattctctgagaatgttctggagatagataactcatttacagggggttctttntaacttaattaaangcccccatggatttttccc

SEQ ID NO: 29834 - DNA, 323 bp, Homo sapiens
cagttctaaaaattaagattttataggattattttgtgttctctagatagtcaaaaatgtattctcaaatttctctgtatattttttatccatgtgccctggtgtttcatttattatgggaatcctattggtatttaggactatgtcttaattttggggcagggcagagtatggaagtagagaggatgggaaggggattgataagataaagtattgtttgtgaagactttgtaaataccatctgggcaatagaataatagaaatttatttatgactcactctacagatcacttttggaggaaaaaatacaaattaaatgtcta

SEQ ID NO: 29835 - DNA, 120 bp, Homo sapiens
  misc_feature 22, 29, 39, 45, 57, 69, 80, 81, 86, 94: n = A,T,C or G
tgcttatgcttccctaatagcngggaccncaggcgcccnccaccntgcctggccatntttgcctttganaaattcacagnntaatntagacgtntgatgaagatgatagagatcatggca

SEQ ID NO: 29836 - DNA, 464 bp, Homo sapiens
ctcgcctgaaggagacacagaagtccatctattacatcactggtgagagcaaagagcaggtggccaactcagcttttgtggagcgagtgcagaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaactcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatc

SEQ ID NO: 29837 - DNA, 196 bp, Homo sapiens
  misc_feature 6, 12: n = A,T,C or G
caaatncaaatnttatacgtgtagccagatactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaat

SEQ ID NO: 29838 - DNA, 337 bp, Homo sapiens
  misc_feature 7, 33: n = A,T,C or G
atgcaanaggaatcgtgctggaaaaagtaggtnttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctacacaaaggcaagaaggaaagaccaagatcataaatattaatggtgaaaacgctgtagtaataaattttcatatg

SEQ ID NO: 29839 - DNA, 272 bp, Homo sapiens
  misc_feature 219, 241, 255, 261: n = A,T,C or G
tgtcgtctgtgttttataaaacaattgtaaatggctactattgtatggagttcaaaggataaagggataaagaaaacatggttcctgccttcaggaagtcttcatttgagggaaagaggtacagaaacaattaatgtaatacaatgcaataaatttccagtgtcctggaaatatagatgcaaaaatactcattatttaacaaacataattgggaagatngggaagattgcttgagcccaanagttcgagaccagnccgggnaatatagggag

SEQ ID NO: 29840 - DNA, 488 bp, Homo sapiens
  misc_feature 8, 13, 31, 33, 79, 109: n = A,T,C or G
gatagccngcctntctccctactgctgctantnaagaccctgagactgacctgcaggacgaaaccatgaagagcctganccttcttgccatcctggccgccttagcggnagtaactttgtgttatgaatcacatgaaagcatggaatcttatgaacttaatcccttcattaacaggagaaatgcaaataccttcatatcccctcagcagaggatgggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttcttt

SEQ ID NO: 29841 - DNA, 123 bp, Homo sapiens
gcgaggccaaggcgggtggatcatgaggtcaggagatcgagaccatcctggctaacaaggtgaaaccccgtctctactaaaaatacaaaaaattagccgggcgacaaagcgagactccgtccc

SEQ ID NO: 29842 - DNA, 490 bp, Homo sapiens
  misc_feature 5, 29, 31: n = A,T,C or G
gcttnctcgatccgcctctgcggtggagntnccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagcttggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataagggggatgagaatggcaaaattagtcgccttcgtcgagagtgcccttctgatgaatgtggtgctggggtgtttatggcaagtcactttgacagacattattgtggcaaatgttgtctgacttactgtttc

SEQ ID NO: 29843 - DNA, 203 bp, Homo sapiens
  misc_feature 25: n = A,T,C or G
ataaaaccactgcactttactcagnagagaaggtgcagctgcttcaggcagttttactcagtagacattaactgaaatgaaagatgagaaaggtgacgaaaactatagcacaacatttgggaaccattagaacacacttaatgctttataaacctaaaaatggttgggatggtaaattttgtgttatgtatatattatcacga

SEQ ID NO: 29844 - DNA, 139 bp, Homo sapiens
  misc_feature 3, 43, 61, 92, 110, 113, 124, 136: n = A,T,C or G
ggnggaagaaaggcccacatgcctgaaggctacatggggtccngtgcgttctgactccagnctacaacagactagatgaagatttgacagancccatgtgataactgacnctntgcaatgtccngattaaatctgnccg

SEQ ID NO: 29845 - DNA, 351 bp, Homo sapiens
  misc_feature 6, 31: n = A,T,C or G
agtagngcacgggttttgccatgttggcctntctggtctcgaactcctgacctcagggtgatcgcctgcctcagcctcccaaagtgctgggattacgggcgtgagccactgcgcctggcctatttttaaaatataaccaaaaaaatgttttttttcaatgttgggtatcagctctctggagaaaggaagaatttctgaatttaaaaggaatcacaaagaaattaaacattcaattatatgaaaatgtacagcttctttaactttaaagcactatcgttataaagtttgaaaaaattttgaaatgtttatagcttattaaaaataaaccgtttatgaaagttacttaaggat

SEQ ID NO: 29846 - DNA, 303 bp, Homo sapiens
tgcctccaaaacacgaatatgtgttagctgtgagaatgacttctattcagtgcaagctctatcagtactacttagatcacttaacaggtgtgggcaataatagtgaaggtggaagaggaaaggcaggtgcaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagccccgatgattatac

SEQ ID NO: 29847 - DNA, 497 bp, Homo sapiens
  misc_feature 16, 21, 27, 33, 45, 71, 83, 173: n = A,T,C or G
aatctgttctaaatgnttgtncctggntctgcnacggaaccctangttttgtttagtattaattcatctgntactggatatgncaagatgaatctatgaacttcaagcaaaacttattgaagctttggtatatgtgagtaatttgttttagagaactggagcctatagcgatntaaaaaaatagcaaatgcaaacattgttatatgaatctactagcatggaaattctcccatgcttaccgtccaagtgaggacttcctctgccatagaacttccagattccttggcattcctgtggatcatcccaatgtgagtaaattgttcctgtggctgactgactgaattaagaaaacagctgaaggcaagcacaggatcgtgttcaaaccacaagaaacacatgtgttggatgagccactcaactttatggggaaggcttaagacatgtaaccaaccttgtgtttgcttgccacttaacaaagtttgtttttaactatgttg

SEQ ID NO: 29848 - DNA, 476 bp, Homo sapiens
  misc_feature 29, 31: n = A,T,C or G
gggagcctttggcgagggtctgtgggtantngcaccagggggttaatcttggctcagtttcctaaaaagcattgattaatttaactggcttttaaatatccccttccgctgatatttgttgtcagctgcctacagtttaatatgcagcgttcacaaaacagctgccagtgctacaattaatgaagcaaaacttaatatgtaatcacaatctaaattagcatcaatactttgacattcattacattggtttgggggaagaaaagtagttctggtatgtttcattgatccccagataccttccaatctggacatgatggggctgattccagatggtttttctgaaatttcattaaggtaggtcagcgtcatttgtctctgtttaggtaaaatataaaaactctgcccagtagcagtggcatcgcttggttcctgatgcccatgttccagaggaattcggataccacaaacagctaaga

SEQ ID NO: 29849 - DNA, 140 bp, Homo sapiens
  misc_feature 105: n = A,T,C or G
caccctacagaaagtggaacagcccggagcctgatgtgaaaggaccacgggtgttgtaagctgggacacggaagccaaactggaatcaaacgccgactgtaaatngtatcttataacttattaaataaaacatttgctcc

SEQ ID NO: 29850 - DNA, 228 bp, Homo sapiens
  misc_feature 3, 21, 52, 97: n = A,T,C or G
aanacatcacgaatggatganggaaacataaagactatcaagaaatccaagnggtaaatgggcgaagtttattcaagcatccggcaatggacttatncgtagttggggaaacgggtgttcccgaataatatcctggaagttatcaggacacctattttaaatataggcctgaattttgtaaagtaatatttaaggtggtccgtgataattaaataaaatgcttaatac

SEQ ID NO: 29851 - DNA, 137 bp, Homo sapiens
  misc_feature 24: n = A,T,C or G
gaagaccaagatgacatgagatgngataaaatgatgaaatgaaatgaagtgaaatgaaattgaaatgagatgagatgaaatgagataaaatgatgagatgaaaagagatgaaatgagatgaaatgaaatgatgagat

SEQ ID NO: 29852 - DNA, 107 bp, Homo sapiens
atgttacagatacgcccagtgacggctcttctgagcatttaccaatcttcttccctttatgtgttccctccaaactgaaagggagtagtcattttccccaaacacag

SEQ ID NO: 29853 - DNA, 457 bp, Homo sapiens
  misc_feature 32, 57, 449, 452, 453: n = A,T,C or G
gagatcgatttgggtagtaatttaaagatttntacctgaagaattctgcttcagagnataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatggatatggaanggnnggac

SEQ ID NO: 29854 - DNA, 163 bp, Homo sapiens
  misc_feature 18, 20, 35, 41, 62, 66, 153: n = A,T,C or G
aaaccgcagataagtttncntctctttgaaagatngagatnaatacaactacttaaaaaatntagncaataggttactaaagatattgcttagcgttaagtttttaacgtaattttaatagcttaagattttaagagaaaatatgaagacttngaagagtagc

SEQ ID NO: 29855 - DNA, 499 bp, Homo sapiens
  misc_feature 20: n = A,T,C or G
gtggttacaatgaagtttanaagcgtaaagaaacttacccctgctcatgaagcttgtgaatgctctagtcaagattcaaaccctgacctttgtcatcgaacttcagcacctgacctttgtcatcaacgccccgcaggaccataagcttttctctgaatcctgaactcaaaaaactctgaaaattgaatttctttttcatatatttgctgccacaactcattttgtggcaaaaccagacctgaactgacttgattccatagtccttatcctacttactggaaatgttcacgtatttcactgcagctatgttgtggctctctaatactctgtattgtacaatgtatggtatagactcctttttaccttcctaaaattgaaaaacctttaaattctgaaaccatctagatctgcaacttctagagaagagatgagaagctgactatggccacctcacacctgccagccagctctcactgctcacaacatgctcgtatcctgt

SEQ ID NO: 29856 - DNA, 236 bp, Homo sapiens
gacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcagga

SEQ ID NO: 29857 - DNA, 467 bp, Homo sapiens
  misc_feature 6, 31: n = A,T,C or G
attgcncaataagataaagtggaatttgctntgtggtgggcgggggtcctttgtgtaataattttgtgtcttgataaagtaggaatatggctgggaccatccctgactctcttttttccttgaatgtgaacacatgagtgaagcatacatccattgtccatggggcaagaacatgaggatgaaaagccaatatgttaaggacatgaagtgaaaagcgggaagagcttcttattcatgttatcactgagcagcgggaactgggggctctgctcattatagttgcccacggcctccagtcaatgaaatttccggccaatgaaatgctctactgtgactgaagcagcaaagagaagatgggtggctttgaaatcagaattggatgcagagggagtcccagaggccaacactgtgaacataagaagggaaagaccagttctgcaagcacagatgtaattttgagaagcaga

SEQ ID NO: 29858 - DNA, 360 bp, Homo sapiens
aaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgt

SEQ ID NO: 29859 - DNA, 325 bp, Homo sapiens
gcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattat

SEQ ID NO: 29860 - DNA, 450 bp, Homo sapiens
ctctatatttcattattggtgaacccacattgtgctgtgttttgtgatattttatcattttctagattcttatgtggatctaataacgaccacttgaacccagtttcacagaatccttatttttctgttcaaattaggaattagggacatggatgaaattggaaatcttcattctcagtaaactatcgcaaggacaaaaaaccaaacaccacatgttctcactcatagataggaattgaacaatgagaacacatggagacaggaaggggaacatcacactctagggactgttgtggggtgaggggaggggtgagggatagcattaggagatatacctgatgctaaatgacgagttagtgggtgcagcacaccagcatggcacatgtatacgtatgtaactaacctgcacatcgtgcacatgtaccctaaaacttaaagtataataataat

SEQ ID NO: 29861 - DNA, 473 bp, Homo sapiens
  misc_feature 29: n = A,T,C or G
tcctccccgagcccatgcgaagcttttantatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctat

SEQ ID NO: 29862 - DNA, 251 bp, Homo sapiens
tggaaggccaagatccactttcgggcagatcacctgaggttgggagtttgagaccaacctgaccaacatggagaaaccccatctctaccaaaaatacaaaattagccgagcgtggtggcacatgcctataatcccagctacttgggagcctgaggcgggagaatcactcgaacccaggaggtggaggttgcagtgagccaagattgtgccattgcactccagcctgggcaacaagagtgaaactccaacgc

SEQ ID NO: 29863 - DNA, 273 bp, Homo sapiens
  misc_feature 6, 31: n = A,T,C or G
agctcncggccaggtatttgcctgtgtactntttgagagagagttaacctggcgcccaacccaatgaaagaaagaatatttactttggaataataaaactaaaataagaataaatgaaaccacctgaaaagaacagccgttaggacttttgcatgataatgttgtacaggaataactgaatgtacattggaagaataatttcatgatcaacacaaaaatgacctcactgtcttttctacaaacctaggatcccgtcgaactgacttcaagccc

SEQ ID NO: 29864 - DNA, 322 bp, Homo sapiens
  misc_feature 2: n = A,T,C or G
anagcctgttgatttggtcactaaaagtattaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatgaga

SEQ ID NO: 29865 - DNA, 444 bp, Homo sapiens
  misc_feature 4: n = A,T,C or G
aatnaccctctgatagtgcttcctttgcatgttaatcatgcttttgttttggggacattcataaagaatagggattaactgaagtggcactgccatgtaacaatagcataattccagtttgttctacttaccaggcttgccctccatgaaaatatacaattgtagataatcttttttaattggagagatttcctcttatgtccaattttatacataaagtaagacttttttattgtgtgcctaaatttgtgtaaatatgactgcatcgtattagtaaactgaattaggtagtgcattcacataaaatttaacatcaccaagaaggctttaccttaagaatgtaatgatgaatcaccattttagatagactgataggtaatttattaactgatttaaaagagaaaagacctatatcatctcagtgagtaccaaaaagcatttaat

SEQ ID NO: 29866 - DNA, 251 bp, Homo sapiens
  misc_feature 20, 21: n = A,T,C or G
tactctccttccaaatagtnncatccaaaactgtttttccctctcccctaccttgtcccccctattaaaatagaaacagggattgattaatgtcccgctcctgaatacatgtaaaatttgtacaaaaatatcttctatgaaaatgatttgtaatctgtagacttattacctgggagatgtcttgatgtaaaatcccatcctttgggttgtgggttttttgttttctccaaataaatctgatctttaaagtt

SEQ ID NO: 29867 - DNA, 163 bp, Homo sapiens
  misc_feature 30, 31, 32, 103, 118: n = A,T,C or G
gagcgccgctctgactcaaaaaagaaaacnnnagaatcaccgtccttcacttttgtccaatgtctgcatagagttaccttttatctttttctattttaaagtntgttggaggagggcnaatttgatacccattaatccatcgtgggcatcacccatgagagtt

SEQ ID NO: 29868 - DNA, 124 bp, Homo sapiens
  misc_feature 23: n = A,T,C or G
tgtaagtcccagctactcaggangttgaggtgggaagattgcttgagcccaggagtttgaggttgcagtgagctgatcatgccactgcactctagcctaggctacagagcaggaccccatctcc

SEQ ID NO: 29869 - DNA, 499 bp, Homo sapiens
  misc_feature 5, 27, 28: n = A,T,C or G
acccntttattctagtgttctctgtgnntttgtaggtatgaatttgccctgtgactctcaggtgtcttgttacattcttcttatgaatcagattattttctcaagagtctggagatcttatgtcatcctgaaaatgtagggaacggtctctttagcttatcagagttagaattgaaatgcatattttccaaattcatatggaccatatcaagttgggagcctgtttagtgcccaatctgaccttggaacactttgccccactatgtgactttaaataagcttcttaacttctcagggtcttggtgctaaggtcagtctttctgaattcatcaaaggttttcaaagatcctctcgccttttgagattctgcatggtagtaaaacccacttcctcactatggaacccacccgtctttctgtgtcagacaattttcttctgcttatggttggggccactcctcacctttaactaatgaattccttttctgctttgtgatgag

SEQ ID NO: 29870 - DNA, 474 bp, Homo sapiens
  misc_feature 5, 19, 30: n = A,T,C or G
cagcncgggtgggctgagnagttaaagtantttgtggctgcagtagcatagaggcgcctagaaattccacttgcaccgtagggcatgctgataccatcccaatagctgttgcccatcgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacat

SEQ ID NO: 29871 - DNA, 288 bp, Homo sapiens
agttccctgcttgactgactgggcctgcttttttcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgaga

SEQ ID NO: 29872 - DNA, 493 bp, Homo sapiens
  misc_feature 24, 25: n = A,T,C or G
tccaaactattgttatcgttgtgnnaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctat

SEQ ID NO: 29873 - DNA, 273 bp, Homo sapiens
  misc_feature 2, 32, 34, 183, 186, 197, 238, 241: n = A,T,C or G
gnaacccctttattttttagtttctgaaattntntatcagaatacattttgttacataatcattttaacaagcttgacattttttcaatgtaagctgactcgatataggtactttaaaacttcctttttaaaaaaccatacgttttatcttggcaaatagctcatcaaaaaaaaaatacacgngtncatgggaagtngtttttcattattttctagcacaacccccaacttaaaattnggnccactgaaatacgtaaatattcctcctatcac

SEQ ID NO: 29874 - DNA, 344 bp, Homo sapiens
  misc_feature 2: n = A,T,C or G
gnctttaaaacagcttcaaaaattcatagtgtgagtcgggcacggtggctcacgcctgtaatcccagcactttgggaggctgaggcaggtggatcgtctgaggctggtctctgactcctgtcctcaagcaatcctcccacctaagacccctaaagtactgggattacaggtgtgagccacaatgcctggcctcctggaactcttaaaataaaaaagttaggatcatttaacaattttcctatcaaaattctagtctttgggtttttcactgggttgatattgttctctttgtgaaaatcatataactcttttgagtgagacttgtaagctatcgttaattatgc

SEQ ID NO: 29875 - DNA, 190 bp, Homo sapiens
  misc_feature 51: n = A,T,C or G
aagtgaatgaactcactcaaaaacctatagcgctggaagagaacctaggcngaagcttggaaaaacactaacatttacaggttgggcagagaaggagccccaaggagacttggtatcaagaaagttattagtggtagaagtaaattttcagtgacagaatgtaaatgacttgttaaaaatgtttgactgg

SEQ ID NO: 29876 - DNA, 153 bp, Homo sapiens
  misc_feature 8, 33, 35: n = A,T,C or G
gaaatggnaatccttgctgcactgttgcagttnanttctgaaaggaacctttccctgtacttacctttcaacatgcttcaatcttatcaacgctacattttgtatttttcaaacaagtataaattctgcaataaagagatgtagttttttttt

SEQ ID NO: 29877 - DNA, 301 bp, Homo sapiens
  misc_feature 17, 43: n = A,T,C or G
tatggccggggaggccnctgaggcagcccagcgcaggggcttntgctgagggggcaggcggagcttgaggaaaccgcagataagtttttttctctttgaaagatagagattaatacaactacttaaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggaga

SEQ ID NO: 29878 - DNA, 447 bp, Homo sapiens
  misc_feature 30, 33: n = A,T,C or G
ggtccccgaaaaccggtagcgcttgcagcnttnttgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaaagaagttgatgaaatgatcagggaagcagatattgatggtgatggtcaagtaaactat

SEQ ID NO: 29879 - DNA, 129 bp, Homo sapiens
  misc_feature 7, 31, 35: n = A,T,C or G
atattcnctggttttacacagggaaatacantttnaagatcacacatcaagactatctacaaaaatttattatatatttacagaagaaaggcatgcatatcattaaacaaataaaatactttttatcac

SEQ ID NO: 29880 - DNA, 303 bp, Homo sapiens
  misc_feature 3, 33: n = A,T,C or G
aangcccggaccggccatttacgcttctttttntggtagaatgtcatcagttaaggcggggcagggcatattcacttcttttgtgattcttcagttacttcaggccatctgggcgtatacgtgcaagtcacaggggatgcgatggcttggcttgggctcagaggcctgacagtaacagcataagcaagggcatagacaagacaactaatttgttttgagagtaagaatgagaactacctggttggagagaagttgcagaaaaatacgtctttttgcttctggtatcctgcaagaatggcaaga

SEQ ID NO: 29881 - DNA, 492 bp, Homo sapiens
  misc_feature 6, 31, 32, 33, 34, 59: n = A,T,C or G
ggggcnccttgtccctgactgcccactgttnnnntacaagagagtacagtgtttcagtnggaattcaggactcctggttttgaggtagaggatgatcactgcagtacttggtttggaattgccacaggggtagcgtaaaccaaaggagggttatatctgcaagggaggtgtaagaaggcaaaataaggaaaaggaggaatgggttttctatttgttcagtttcatcaactaatttatacacttaatacaacttcagtgtcaattgctattaagaaatttttagttgggctgagctggttctcttgtgaaattgtgctggttatctttaagcttatcagttatttgtccaattaaacacttttcaccagtatttagtccgagttgtacagacgatgtatttggattttgtcatggttcatctacagactcaaaacataatcattttaaagtaccttgggagtgtgtagagtaacttctataatagctttatga

SEQ ID NO: 29882 - DNA, 195 bp, Homo sapiens
  misc_feature 31, 34: n = A,T,C or G
aacacccctaatatgtaatctccaggagctnttncctgtaatttttatttatttaggcagttacataggtgatgggggaaattgttaactacctttcattttcctgggaagtcaaggttacatcttgcagaggttgttttgagaaaaaagggcccttctgagttaaggagccatagttctatcaatgatcaaaag

SEQ ID NO: 29883 - DNA, 274 bp, Homo sapiens
  misc_feature 4, 6, 38, 66, 89: n = A,T,C or G
tgantnaactagaaattactttgcaaaggagagccttngctgggacccccgaaaccagacgagctncctaagaacagctaaaagagcgncaccccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacacta

SEQ ID NO: 29884 - DNA, 472 bp, Homo sapiens
  misc_feature 33, 57: n = A,T,C or G
acattcccagggtcttggctgcctgtgggcttncccaggtggcctggaggtgggcancagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcggtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaaagttgtaaaatag

SEQ ID NO: 29885 - DNA, 277 bp, Homo sapiens
  misc_feature 6, 28, 30: n = A,T,C or G
gttccnaacaagtattctgtagatccantngattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtaactacttttgtaacttcgtcagaataaaatatattgaaagcg

SEQ ID NO: 29886 - DNA, 422 bp, Homo sapiens
  misc_feature 5, 11, 32: n = A,T,C or G
atggnccgggngtccccctcttttaccaaggnacccgcctttttgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagatttttgaagtagatcctgacactaaggaaatgctgaagcttttggacttcggcagtcctgtccaaccttcaggtcactcagcctacagttgggatga

SEQ ID NO: 29887 - DNA, 115 bp, Homo sapiens
aattttgtatctagcctaaagttcccctaggctttcttgtctcagcaactttcccatcttgtctctcttggatgatgtttgccgtcagcattcaccaaataaacttgctctctgg

SEQ ID NO: 29888 - DNA, 367 bp, Homo sapiens
  misc_feature 14, 17: n = A,T,C or G
tggaggtagtggtngtncctgtgcaaaatagatgcggttgcttcagctgctcagaagtggtggcaacacaaggtcaaagtgtgcatttcaggccattcactcagtttggtttggtgtgccttaataaacctttggtatagttaaaatggggatctaagattgtcagatattaaccttggttgacaatttgcttatcatttgaaaagcaataagaagccttggttgatttctgtctggagtgcagtttaaagctattataagctcattgaaatgaagtgtagagttttaaagtagcaaccctaactcttccaactacacttacataaagttattcttagaaaaatataataaaactgattattgaatg

SEQ ID NO: 29889 - DNA, 478 bp, Homo sapiens
  misc_feature 27, 29, 54, 80, 128, 170: n = A,T,C or G
gaacccaaagcaaagcacagctcaagntntctccttggagaaaacctgaaaatncaacttgttcaagagaaggtcttgtncgtgcctaagttctagagcctcctgacgtgagcatggctgagagtgangaccgctccctgaggatcgttctggtagggaaaactggaagngggaaaagtgcaacagcgaacaccatccttggagaggaaatctttgattctagaattgctgcccaagctgttaccaagaactgtcaaaaagcatcccgggaatggcaggggagagaccttcttgttgtagacactccagggctctttgacaccaaggagagcctggacaccacctgcaaggaaatcagccgctgcatcatctcctcctgcccagggccccatgctattgtcctagttctgctgctgggccgctacacagaggaggagcagaaaaccgttgcattgatcaaggctgtctttggggaagt

SEQ ID NO: 29890 - DNA, 401 bp, Homo sapiens
  misc_feature 3, 29, 394: n = A,T,C or G
gcncccatttttacacacttctgtttttntttccaagagttgtgacttcagatgcctcctgaaagtggcttggattctccaggtgtccatatgtcatactttggaaacggatgatatgaattacaatgtgttgccctctggatttgtgcactgtactgtgtgcacaatctgcatgaaaattgcgtagacttcagtgtgggaaaattaggtgctgaactgactgattctttgttgaggaggatggtctcaacatcattatggagaggccaggtgtggtggctcatgcctgtaatcccaacactttgggaagctaatgcaggaggatcccttgaggctgggagtttgagaccagcctgggcaacactggagacttcgtctctacaaaaaaaaaaangttttta

SEQ ID NO: 29891 - DNA, 459 bp, Homo sapiens
  misc_feature 28: n = A,T,C or G
caatccctctcatctaaaatcctctccntttgtgaccttgccctgtaccattaagaggtgacgtctctgtcccatgcccctgaatctgagcctgtcatgtggctgctttgaataagagaatgtggtggaagtaatgcagtgctagttctggcatagccttaattggcctgacaacttccatttcttgcctcttggtggcagccaccatgtgagagttgtgactaccttgagaccaccgggctataagaagctgcccctccgtgtagagaggccctggaagatgagatgccacttgaagacagagagagggcaaggaacagtgaagcaccaaatgtgtaagaaaagagttcacctggaaaatggaagagagaagacaaaattaccaatatcggaatgggagaggtgaaattaccacagatgctacagatactaaaaggattgtgaagagaaattataaac

SEQ ID NO: 29892 - DNA, 467 bp, Homo sapiens
gcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctattt

SEQ ID NO: 29893 - DNA, 323 bp, Homo sapiens
  misc_feature 1, 5: n = A,T,C or G
naaancccttttcatctgtcccgctgcgtttttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttt

SEQ ID NO: 29894 - DNA, 314 bp, Homo sapiens
  misc_feature 2, 6, 49, 52: n = A,T,C or G
cntttntttatggcccgggaaatgcccggcatcacagaactgcaaaccnttnttggtaggaggacacgggaccatttccttttcctgtctccatctgactctggaaggcggggacaagacatttaaaaccaggaccactccaggaggacagcacattagctactgccctccagctcccttcagtgttgtttccgtaaaggacttataaactggcgagggcggtggcttccaaaagcgcacaggcgtcccttttccaacttggtcttcttattttcccttcctgctccataactacaacgtgtttctgttcgttc

SEQ ID NO: 29895 - DNA, 254 bp, Homo sapiens
  misc_feature 30, 31, 254: n = A,T,C or G
ggtgccccaaagtggatgaggtgaagtctnntttcaagttccaaatgaagaaggtgcatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttn

SEQ ID NO: 29896 - DNA, 183 bp, Homo sapiens
aagaaagaattgtcctattacctgaaatcagtttggggttgggatcattttttatcttaattgctttagcaatgtaagtgaatcagaactgaagtggaaaatgttcttgggtttatgttttcaacacaaagtatgacgatgcttacattccatttataggagtggcaaggaatttactatgcc

SEQ ID NO: 29897 - DNA, 346 bp, Homo sapiens
cacacctgtaacgttttggttgagatgttttatggtggacgagtactgtggatgcgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaattttggattgccatgcaagggcttaca

SEQ ID NO: 29898 - DNA, 424 bp, Homo sapiens
  misc_feature 6, 56: n = A,T,C or G
gctgcngcggatggacactaatgcagcctttattggagaatactttgcttcatagnattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccattccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatga

SEQ ID NO: 29899 - DNA, 431 bp, Homo sapiens
  misc_feature 2, 14: n = A,T,C or G
anaaccccccaagnattcctcatgcctctttttttttcccttccctctgtctacctactaggcctaggaagcagtagatctactttatatcactatatattgatttttattttatatatttccatgtaaaatgatttatacaatatgcacagtttcatgcctttcaattggaacaatacttctgaggttttacatatatatcttgttttgtttatacattcacttgttgatgtatctgtgggttgcttccaatttggagatactatgaaaaaagctgcagactgtgtagacatatgttttcatttctcttgaatacctagaaatgcaatggctgtgttgtacaatacatttatgtttagatttttgggaaatgccaagctgttttccaaggtggttggaccattttacattcccaccagcaatgtagggga

SEQ ID NO: 29900 - DNA, 424 bp, Homo sapiens
  misc_feature 24: n = A,T,C or G
gctgagggggcaggcggagcttgnggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaaga

SEQ ID NO: 29901 - DNA, 477 bp, Homo sapiens
  misc_feature 30, 34, 35, 58, 427, 429, 434: n = A,T,C or G
aaatccccaattaatagatagaaaatttgngttnnttaatcatacagcttattatagnccatgccttctgggcatcctgactttgtactgctttgatcttgcccttttatgttgggttttcttaaaaagttaatggatcctattcattcatagttcattcaacaaatatatattttgccctactatgtgctgggcacaattctaggaattgagctcccagttactgatttggaaactcagtatttctttcttttttgtctttttgagacagagtcccactctgtcgcccaggctagagtgcaatggcgcaatcttggctcactgcatcctgtgtctcctaggtttgattctcatgcctcagcctcctgaatagctggggttacaggtgcaccccactacgcccggctaattttatatttttaggaananaaaangggtttcaccagcctggaaaacatagtgagaccccatctctac

SEQ ID NO: 29902 - DNA, 460 bp, Homo sapiens
  misc_feature 24, 25: n = A,T,C or G
tgaacatgggcatcagaggccagnngctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatacctggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacaga

SEQ ID NO: 29903 - DNA, 253 bp, Homo sapiens
  misc_feature 3, 34, 36, 253: n = A,T,C or G
ganatccccctaaggagattgaaaaagcatatantntataaaatatgaaacaagaaaatatcctacaaatgataatttatcaactttttttcctggaggtagcaagaataaataaaatcttattttctatgcaaaacagtgcttttaaattaaaattattcacctagaatgtctacagatactttcttcagagtcctttttgttaagtaatctaacatattttaagatactctgataaatacataagcggcgn

SEQ ID NO: 29904 - DNA, 491 bp, Homo sapiens
  misc_feature 43, 44: n = A,T,C or G
tatggccggggaaaccctatgcatttacctttgggcataattnnaatgcaattgactctccatattcatgggttctgcatccactgattcaaacaactgtggaacaaaattgtcagaaaaaacaatacagtgataaaaaatgatacaaataaaaaacaacatggtataccaactatttacatagcatttacatcgtattaattgttattaagtaatctagagatgatttaaagtatataggaggatgtgtgtaggttatatgcaaatactacactattttataccagtaacttgagcatccatggattttggcatacaagggggatcctggaaccaattccccatgcatatcaaaggatgactgtatgagttatctgtaaaatgggtttgggttgaaatgtttagaaaacagctagaaatacaagactggctgttggatgaaaaaaacataggactaggaaattcaggtatgctagtctttttggagtatt

SEQ ID NO: 29905 - DNA, 476 bp, Homo sapiens
  misc_feature 29, 32, 56: n = A,T,C or G
caatcctggcagccagtttgaatataatnttnaaggagtgacttccaaggaaatgnctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttct

SEQ ID NO: 29906 - DNA, 429 bp, Homo sapiens
  misc_feature 7, 28, 33: n = A,T,C or G
atgatcngagaatctggtatcaacaagnaagtntgtagttatgatctctgaaaataagtcccttgctatgttccttatgcattatttaagctacagtacatggctgtgatgaatgcagtgtgagaactccatttctaagcataataaatagaaatcagatgcaatcactcatgatacttcacagaattgtgctgagagcatgtttgcccagtgatgttctactgagcaattttgtttgagacagtagaattttcattattaaaagactttagattctggatcattttgtatttatgctgtttacaataataatgggtatgatcattaaggtactttgcaagtgacattaattttattactcctctccaggttaaatttgacattaaggttttcagcctgtgtagttaatgtatagctctctggttttct

SEQ ID NO: 29907 - DNA, 313 bp, Homo sapiens
taacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggac

SEQ ID NO: 29908 - DNA, 357 bp, Homo sapiens
  misc_feature 4, 6, 7: n = A,T,C or G
ggancnngcgaacaacatggcggcggaatttgttagcgattttcagcagagacgtacaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaagtaagtctatcacatcttttttactttgttctgagtttattt

SEQ ID NO: 29909 - DNA, 234 bp, Homo sapiens
  misc_feature 3, 18: n = A,T,C or G
cgnacgagctacctaagnaacagctttaagagcacacccgtctatgtagcacaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaagccagaga

SEQ ID NO: 29910 - DNA, 204 bp, Homo sapiens
gcaaacctgtctcatttgtacttcagtctcgtaatcatggtatctgtctctgtgcctttattttcatacttttctaccaatgccccaggaaaactatattttctcacaaaaccagcgaagattttctacaaaagtcagtggtcaagcgtgcaatgttagttgaacatcaaaagagcagtgtgccagtctactatggggaaagct

SEQ ID NO: 29911 - DNA, 100 bp, Homo sapiens
  misc_feature 33: n = A,T,C or G
tgaggtgggaagattgcttgagcccaggagttngaggttgcaagagagctgatcatgccactgcactctagcctaggctacagagcaggaccccatctcc

SEQ ID NO: 29912 - DNA, 395 bp, Homo sapiens
gtaagcaactgaatttgcaagcaatgtattgattgtaaatgaattatttcgtacatccctgtagttgtccccagtctccattccaataggatccctggagctgattgggagagaagaaaaagagatacctgattggtacccctcctagctgttccagtagccaggtgggcttggcagagactatgaaagaggcaagctacaagtggattgagactgtggggaatcttacaaagaaatagggttgtatattgtttcgactccttttgcgtggttgtcttctccaagctgcctagataagtcagcagaagggctcagatgaaacatgttttgtaaatgtaactttcaggtaatgaaacagtaccttcccattattgagctcttttttttaaatagct

SEQ ID NO: 29913 - DNA, 179 bp, Homo sapiens
  misc_feature 178: n = A,T,C or G
atgacaactatgaaaccgatccacatacgagaacagcaatactccaaaacttcaaaaggtgattagctatagatggtgggattctagatgatttttgttattttctagaccttgtattgagtattctatagtaagtatggattcatttttataattaaaaatatatttttaaatgggnt

SEQ ID NO: 29914 - DNA, 308 bp, Homo sapiens
  misc_feature 6, 31, 33: n = A,T,C or G
gaatcncgaatttttgctggcttagtgcttntnagcatggagcctttcacaggaaatgctttagaatcagagtcagagacctgtgacacttctggggagtcagtatgtaaaatagttagagtgcaggctccagagtcagtctccctggttccactgttcactagaagtatatccttggatagattacttagctcgtccattagatttgctgtctggacgtgtcagtagtaacaatctcaatgtcacacggttattgaagagatccatcatagagcttacattctagtaaggagagacaggcagtatac

SEQ ID NO: 29915 - DNA, 206 bp, Homo sapiens
  misc_feature 30, 32, 54, 99, 126, 155, 160: n = A,T,C or G
gcccaaccgcatagctgcctatgccttttnanaactggctgctgcgtgtgaacncgaacagacggagaagatgtgctagggagaatctgcctccacagncacccatttcattgctcgctgcgaaanagacgtgagactgacatatgccattatcnctttnccagtattaaacactcatatgcttatggcttggagaaatttcttag

SEQ ID NO: 29916 - DNA, 290 bp, Homo sapiens
cctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttctttttttt

SEQ ID NO: 29917 - DNA, 230 bp, Homo sapiens
  misc_feature 25, 32, 230: n = A,T,C or G
attgccgaataagcataaccctganattcttnctactgatgagaacattatctgccatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcn

SEQ ID NO: 29918 - DNA, 139 bp, Homo sapiens
cttcagcctgaaaaaaaaggtcttgaaaatgttttcttgtagttttgtttggttctaaacaacaaataggttttaatcactcgaaatggaattatattgtgtattcattgaataaattttttttgaaagtaagcttctg

SEQ ID NO: 29919 - DNA, 490 bp, Homo sapiens
  misc_feature 43: n = A,T,C or G
gttcacgcctgaagttactcccgacatggtttacttaccgagnagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacagga

SEQ ID NO: 29920 - DNA, 213 bp, Homo sapiens
  misc_feature 11, 12, 20, 35, 44, 74, 80, 83, 107, 127, 163: n = A,T,C or G
aagtccctgcnngtccactnccctttggggctggngctgccacncagcaataatacaattttctctgtgctttnttaggnccngtgtcctctgtctttgaggctggngaggaagcaagagtcctganctttcatgctgcacaatatgagcatgcaaaaagctngcttccagcagaacatgttccctcgtgtccagttgccggaaaggaatttg

SEQ ID NO: 29921 - DNA, 494 bp, Homo sapiens
  misc_feature 2, 21, 48, 80, 129, 167: n = A,T,C or G
cngaagcccactatactcatntaatgctttacaactctcttgcaaggntccctggttgtgaaaatacatgagataaatcntgaaggccactatcatcctccttctgcttgcacaagtttcctgggctgnaccgtttcaacagagaggcttatttgactttatgctanaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataactgaaatcaaagatggagactttaagaacctgaagaaccttcacgcattgattcttgtcaacaataaaattagcaaagttagtcctggagcatttacacctttggtgaagttggaacgactttatctgtccaaga

SEQ ID NO: 29922 - DNA, 130 bp, Homo sapiens
  misc_feature 24: n = A,T,C or G
tgcgtcgatgaagaacgcagctanctgcgagaattaatgtgaattgcaggacacattgatcatcgacacttcgaacgcacttgcggccccgggttcctcccggggctacgcctgtctgagcgtcgcttcc

SEQ ID NO: 29923 - DNA, 365 bp, Homo sapiens
gaaagagcattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggatt

SEQ ID NO: 29924 - DNA, 114 bp, Homo sapiens
  misc_feature 25, 26: n = A,T,C or G
ctgtcaatttcaattggataacatnnttgtcaagtttttttttcctgattatttgatgctagctggaattcaagaaatggcattgaccttattcaaataaggaaatattttagt

SEQ ID NO: 29925 - DNA, 471 bp, Homo sapiens
  misc_feature 13, 14, 62, 65: n = A,T,C or G
gaaaattcccggnntaaaagttccctggttgtgaaaatacatgagataaatcatgaaggccnctntcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatca

SEQ ID NO: 29926 - DNA, 415 bp, Homo sapiens
  misc_feature 11, 23, 36, 50, 64, 83, 132, 154, 186, 228, 230, 369: n = A,T,C or G
gtggtaatttnagaaccagtcangtactatgtagantatcattgatgccncaggacacagtagnactttatcaaaaacatgangacagggacatctcaggctgactgtgctgtcctgattgttgctgctggngttggtgaatttgaagctggtntctccaagaatgggcagacccgagagcatgcncttctggcttacacactgggtgtgaaacaactaattgtcggngntaacaaaatggattccactgagccaccctacagccagaagagatatgaggaaattgttaaggaagtcagcacttacattaagaaagttggctacaaccccgacacagtagcatttgtgccaatttctggttggaatggngacaacatgctggagccaagtgctaacatgccttggttcaagggat

SEQ ID NO: 29927 - DNA, 209 bp, Homo sapiens
gaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtc

SEQ ID NO: 29928 - DNA, 494 bp, Homo sapiens
  misc_feature 2, 34, 38, 40, 52, 70, 78: n = A,T,C or G
tntggcccgggactctggggggggaaaagctccntccntntactgtgagacntttgttaagtgacctctnttgtttantcagcttttaaggataaaaaaggtattttaaaagttggatatttaggatatttgaggatattcctttatgagctctccatatccttcttgagaaactggttaaaaaaggaataggggttgagtgttacagagagtagtctgaagattcctgtgtaaaagcaaagctaacaagcaatgaagacatgaagcaaaatactaatctaattgtgtaaagaaaggatattttaataagttctttctgcttgctgctaagagtttgctaaagtgtcatgaattattctggttattactaaagtttctatgaaacaagtagatttttaagaataaatgtttctggaaaagaactatgttatgattttgtagaaatgtaaagattacttgaggtgtttaaaataaatttttcattcagactacct

SEQ ID NO: 29929 - DNA, 303 bp, Homo sapiens
catcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttac

SEQ ID NO: 29930 - DNA, 473 bp, Homo sapiens
gagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcacctgccgcagcagcaacagcagcaacaacagcagcaacaacagcagcaacagcagcacagtaaagggcatacatttcctgctttcaccaattaacca

SEQ ID NO: 29931 - DNA, 467 bp, Homo sapiens
  misc_feature 72, 75: n = A,T,C or G
gaaggtttaccattttgaacttgaatgttgacattgatattttgagagtgctcaaactgtgtcccctgtccngtnggggactagacagtggttagtttaccttgtgtttgtgtatgtaggatgggatgtatagtgctctgttgatacaaggaagagcttcaccagtggcttgctgtagagttttcaaattaactgaaccctttcctcggcttgataataatgggattcttcttcaacatacaacaaactttgtttttcttgggagattttaacagtgttacattctgaattttttaggttatgtccccatgtctcagctacgtgagactttctgcttttctgttagttactgggacctacccgtggccccactgttattgttactagaaagcctggcctaatgtgagaaataattacagataaaactttttttttcagtgctgccttaacaatttcaggaaaagact

SEQ ID NO: 29932 - DNA, 294 bp, Homo sapiens
gggattacaggcgtgagccaccgcgccccggcctgagtgagtcttaatccgtggccatctgcgttcctgcaggcttcatctggccctatggtcccctggcatcatggctgccctcagatcccttgtgaagcccaagatcgtcaaaaagagaaccaagaaattcatccggcaccagtcagaccgatatgtcaaaatcaagcgtaactggtggaaacccagaggcattgacaacagggttcatagaaggttcaagggccaggtcttgatatgatgcccagcattggttataggaac

SEQ ID NO: 29933 - DNA, 264 bp, Homo sapiens
  misc_feature 73, 108: n = A,T,C or G
taggccgggggatctggagctctacttcaggtgctgctataatgcctcatctaatcaggactaaattgtgtangaaactgcagtgggaagaatatgctttctgctcangctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctataga

SEQ ID NO: 29934 - DNA, 481 bp, Homo sapiens
  misc_feature 155, 320, 415, 425: n = A,T,C or G
gagcattcgggccgagagtctcgctccgtggccttagctgtgctcgcgctactctctctttctggcctggaggctatccagcgtactccaaagattcaggtttactcacgtcatccagcagagaatggaaagtcaaatttcctgaattgctatgngtcttgggtttcatccatccgacattgaagttgacttactgaagaatggagagcagaattgaaaaagtggagcattcagacttgtctttcagcaaggactggtctttctatctcttgtactacactgaattcacccccactgaaaaagatgagtatgcctgccgngtgaaccatgtgactttgtcacagcccaagatagttaagtgggatcgagacatgtaagcagcatcatggaggtttgaagatgccgcatttggatnggatgaattncaaattctgcttgcttgctttttaatattgatatgcttatacacttacactttatg

SEQ ID NO: 29935 - DNA, 102 bp, Homo sapiens
  misc_feature 2, 3, 7, 17, 27, 49, 52, 61, 90, 92: n = A,T,C or G
cnntgcntccttttgcntgccgggtcnagaaaatgcctttttttccccntantgaaaagangggcttgtgttgcaccgtaaatctgtgcnancatttactga

SEQ ID NO: 29936 - DNA, 342 bp, Homo sapiens
  misc_feature 9, 11, 19, 121, 167, 171: n = A,T,C or G
gtctttagntntgccgctnaccatggaaaacccttaatgcccaccactagtattcctttacttattaaggcaatctgtcaggaaactcaggcctctaatgataaagttagctcccttggcngacagaattaattaattaattaattaattattttctgagacggagnctcngctttgttgccaaggccagagtcgagttgcagtggctcagtctctgcctgctgcagcctgcacctccaaggagaattgcttgaatctgggagctggaggttgcagtgagtcgagattgtgccacttgcccttcagcctgggggacaagagtgaaactccgtctcaaaaatg

SEQ ID NO: 29937 - DNA, 422 bp, Homo sapiens
  misc_feature 3, 19, 27, 28, 29, 30, 37, 41, 48, 59, 67, 72, 77, 93, 99,109, 113, 135, 291: n = A,T,C or G
ctntggcccggggaagtcnttaaagannnnttgtgangtcntgagacncaggtcaaaantcaacccntaacnagagntctggaagacagttancttccnaacccctccnagangtacttttgaggggttttagantttcagtggagaaagtccctgcagatgttgtggaaatagcaggagaactagaattagaagtaaagcctgcctgggaggggagggacacgcgccggagcctgttgggggatgggaagtaataggagggagagtattaggacccaatgccctaatgcnatgcggggcttaaaacctagatgacaggttagtgggtgcagggagccatcatggcacatgtatacttatgtaaacagtcccgcgctttctgcgcatgtatccaggaacttaaagtaaaattaaaacaaaca

SEQ ID NO: 29938 - DNA, 321 bp, Homo sapiens
  misc_feature 66: n = A,T,C or G
tatggccgggaaatgaactcaatctaaattaaaaagaaagaaatttgaaaaaactttctctttgcntttcttcttcttcttttttaactgaaagctgaatccttccattttcttctgcacatctacttgcttaaattgtgggcaaaagagaaaaagaaagattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacattcgc

SEQ ID NO: 29939 - DNA, 468 bp, Homo sapiens
  misc_feature 24, 71: n = A,T,C or G
attgacattgctattttaacaganaagatgtctctgtgggtgggagtttgggggtaagaaggagccatggnggcccagagtatagtgagagaagccaagcaaggtaaaaaagagtgttcagctagggtgaagagccatccaacagagaagttagaccctgagcatgaagataaatgcctttatggacactgacctctctgtgatcatcaaacatactgttatgaactgaatgtttgtgcttccccaaaactcatgtgttggagccagccaccagcatggctacatttggagatggggcctttaaggaagtaattaaggttaaacgaggtcataaggatggggccctgatccactaggatcagtgtccttgtaagaagagacaccaaacatctcacttgccgtctctctgcacacatgcactgaggaagggctatgtcagcacacagcaagaaggcagccctctgcaag

SEQ ID NO: 29940 - DNA, 305 bp, Homo sapiens
atagttcatacatataaatggtggtgaaataaagaaataaaacacaatacttttacttgaaatgtaaataacttatttatttctttgctaaatttggaattctagtgcacattcaaagttaagctattaaatatagggtgatcatagttcctctaccaagtctggaaagaacatctcctggtatccacaattacaccaggttgctaactgtatttgtacatttccctttgcattcgcttttgttcttgctagaaacccagtgtagcccagggcagatgtcaataaatgcatactctgtatttcgt

SEQ ID NO: 29941 - DNA, 479 bp, Homo sapiens
  misc_feature 7, 11: n = A,T,C or G
taagcanatgnacattccttagtctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaaacccaccaaccagaacgtggtttgcctgaggctgtaactgagagaaagattctggggctgtgttatgaaaatatagacattctcacataagcccagttcatcaccatttcctcct

SEQ ID NO: 29942 - DNA, 107 bp, Homo sapiens
  misc_feature 2: n = A,T,C or G
anttgacagtgtaggaaattgtctattcctgatataaattactgtagtacctcttgcttaaggcaagaagtttcagatttactgttgaaataaacccaactcttcac

SEQ ID NO: 29943 - DNA, 218 bp, Homo sapiens
  misc_feature 6: n = A,T,C or G
aaagangatatacaaactccgagtttgtaccttcatcaagatctaacagctttaatacagatagaaacatagacctgagaaattagatgttgaaatagttatgagtattgatcatctgaaacagaaaatccctccagcactgttttataaggaaacatacttaggtccaaatgaagttttgaagaatggaatgtattgcagcctttatgaagttgtgg

SEQ ID NO: 29944 - DNA, 353 bp, Homo sapiens
  misc_feature 10: n = A,T,C or G
ggagtgaganggcagagaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagcgactcatccgaagaaaatggagatgacagttcagaagaggaggaggaagaagaggagacttcaaatg

SEQ ID NO: 29945 - DNA, 213 bp, Homo sapiens
cgagtgtgacgatgtgggtagtttaagaaaaaggccttatcttttagaaatacatacggaaacatttgtggataaaacgttgggctgttatttgcttacaaaagttgtgggagtagatggggtgtggattggatggttgttgggacaggatgattagtacctaattctgtctgcacttacgtacgattgaaattctccctaggatatagaacc

SEQ ID NO: 29946 - DNA, 471 bp, Homo sapiens
  misc_feature 48, 98, 142: n = A,T,C or G
gaggggaaaactgctttcatacttagatgttgaaggaaattccatcantatggtgcgaatgacattcctgaaacttctgactgcctctgctcggcaanaatttcacctaccactgtcatcagtcagcagcctggtatgatgngtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaag

SEQ ID NO: 29947 - DNA, 472 bp, Homo sapiens
gggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgata

SEQ ID NO: 29948 - DNA, 123 bp, Homo sapiens
taaatactagaagacagtgttctcagagaaaatgattttaagcttatgcaaactttctagaaagaatgctcatggatacactctagaaaatgggggtgggggagggagaagaaaagagattcc

SEQ ID NO: 29949 - DNA, 228 bp, Homo sapiens
  misc_feature 228: n = A,T,C or G
ataagaaatctgggcacaaaacttgtggtctttacttttgaatagctacccaagaaaaggttttaaaggtaaaagttatgagtaatgtcatcacaataagctcttgtttaaaattcttttcttttatgtataattaggtttatgtttcatgtctttttaaaaccttataaaagatttaattatcacatctattcttcaatgtggaaatattaaatattgttggttacn

SEQ ID NO: 29950 - DNA, 443 bp, Homo sapiens
tattgagagacgcccaagcagatggcctgcgatgaagtttagaagaggctctggacatcctgcctatgctgaagttgaaccagttggagagaaagaaggctttattgtatcagagcagtgcttaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgc

SEQ ID NO: 29951 - DNA, 207 bp, Homo sapiens
agagcttgtctcaatggatctagaacttcatcgccctctgatcgtcgatcacctctgagacccaccttgctcataaacaaaatgcccatgttggtcctctgccctggacctgtgacattctggactatttctgtgtttatttgtggccgagtgtaataaccatataataaatcacctcttccgctgttttagctgaagaattaaatc

SEQ ID NO: 29952 - DNA, 156 bp, Homo sapiens
gggtagctggcaggatgtttgaaagatttcttcttcacaattcaaaaggcttggtcgagtgacaggattcatatcccaaacctcaacatcacacaatactcccatgtaacaaatctgcacatgtacccactgtattgaaaataaaattaaaaaaac

SEQ ID NO: 29953 - DNA, 471 bp, Homo sapiens
  misc_feature 437: n = A,T,C or G
gcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtanggatgaaacaatttggagaagatagaagtttgga

SEQ ID NO: 29954 - DNA, 205 bp, Homo sapiens
cgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagc

SEQ ID NO: 29955 - DNA, 201 bp, Homo sapiens
ggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgaggg

SEQ ID NO: 29956 - DNA, 472 bp, Homo sapiens
  misc_feature 8, 10, 16, 23, 26, 45, 99: n = A,T,C or G
gaatgtgngngtggcncacagcntantaaaccccaacacccgagngatgaatagccgaggcatctggctggcctacatcatcttggtaggattgctgcntatggttctactcagcatccccttcttcagcattcctgttgtctggaccctggaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatggggtt

SEQ ID NO: 29957 - DNA, 149 bp, Homo sapiens
ggggaatgttccccttaaaaagcaaggagtctaaaaagcatgaaaagcttgagaaaccagagaaggagaaggaaaaaaagatgaagaatgagaacgcagacaagttacttaagagtgaaaagcaaatgaagaagtctgagaaaaagagc

SEQ ID NO: 29958 - DNA, 244 bp, Homo sapiens
  misc_feature 2, 4: n = A,T,C or G
tntntgtcaatatttagtaaggcttttcttttttaatttccggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacatcc

SEQ ID NO: 29959 - DNA, 461 bp, Homo sapiens
  misc_feature 6, 24, 53, 83, 151: n = A,T,C or G
gaggcnttgaggcagccagcgcangggcttctgctgagggggcaggcggagcnttgaggaaaccgcagataagtttttttctntttgaaagatagagattaatacaactacttaaaaaatatagtcaataggttactaagatattgcttancgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagatt

SEQ ID NO: 29960 - DNA, 489 bp, Homo sapiens
acagaaacctctctgaaactctcaacatcaaagaccaaaggtagatgaatccgtgaagatgaggaagaactagcacaaaaaggctggaaattccaaaaaccagaatgcctttgtgatccaaaggatcacaactcctcaccagcaagggagcaaaactggatggaaaaatgagatagatgaattgacagaagtaggcttcagaagggtaggtaataacaaaatcctcctaaaggaggagctaaaggagcatgttctaacccaaggcaaggaagctaacaaccttggaagaaggttagacaaattgctaactagaataaacagtttagagaagaacataaatgacctgatggagctgaaaaacacagcacgagaactttgtgaagcatacagaagtatcaatagctgaatcaatcaagtggaaaaaaggatatcagagattgaagatcaacttaatgaaataaagtgtgaagactaaattagagaaaaaac

SEQ ID NO: 29961 - DNA, 120 bp, Homo sapiens
  misc_feature 5: n = A,T,C or G
tcccngggaattcggccttacggccggggagctgagatggcagcattgcactccagcctgggcaacaagagtgaaactctgtcagaaaggaaaggaaaggaaaggaaaggaaaggaaagg

SEQ ID NO: 29962 - DNA, 227 bp, Homo sapiens
atatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcg

SEQ ID NO: 29963 - DNA, 463 bp, Homo sapiens
  misc_feature 1, 35: n = A,T,C or G
nttcgcgattacaatgatgcagcacatggcgcgtnttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaaggga

SEQ ID NO: 29964 - DNA, 103 bp, Homo sapiens
gagagggaagtacagcagctgcctaattttttttccataaaaccgtgtgtgtgttgtgtgcatagagaaagatggggaggaaaggaagacagagtgggagagg

SEQ ID NO: 29965 - DNA, 363 bp, Homo sapiens
aatgagatgctcattcttcactaattcttgcaaagcatctgttcactggaaattggatgctatagtaagtactaaagaaaaagaagccattaagacaaatcgagtccttcttctgaaggagcttagtgcctagtggtggaggaagagtcagacaactcattaatgatgaccccactgtgtgataaatgctgtcaagggaattgtagggtgttgtggaggcacagagagattcaagggaggtgccttggaaaagtgacatggaaacagctaactagacagatcagcaaaggggtgtgtgttggggagaaggaagaaatatatgtagtaggcacaggcaaggatagtatgtggaagcacactgat

SEQ ID NO: 29966 - DNA, 472 bp, Homo sapiens
  misc_feature 358, 387: n = A,T,C or G
gtactttaggaggctgaggcaggaggattgcctgagcccagggaattcaagaccagcctggccaacatggtgaaaccccatctctgctaaaaatgcaaaaattagctgggtgtggtggtgggcacctgtaatcccaactactctggaggctgagggatgagaatcacttgaacccgggaggcggaggttgcagtgagctgagatcacaccgctggactccagcgtgggtgacagcgagactccatccaaaaaaaacccaaaaaacaaaaaacagattggcaaaaaacatgatccaactatatgttgtctacaagaggcacacttttagattcaaagacacaggtagaaagtgaaagtntagaaacagatataccatgcaagcagcantcaaaagatagctggagtgactatgctaatgtcaaacagtagattttaaggcaaaaactgtttcaagggacaaagaaggacatca

SEQ ID NO: 29967 - DNA, 473 bp, Homo sapiens
aatgaaaaaattccccacaaaccaaaaattaccaaaatagtcacaagaataaatagaatacatatataatgtttccacaaaaaaaaacaactctaggtctgcatggcttcactggttaattatataaaatatttaaggaggaaataataacaaatctatagaaataatttcagaaaatagagaaaaaagaaacacttcttagtttattttatgaggccattattacacttatatcaaaatcaaagaaattacaaggaaaaaagctctattaatcaaaattatgcataaacatggacacaacagtccttgacaatgtattacacaattaaatccagaaatatataaataggatagtttatgacaagtatattttatcctaggaattcaaggttggtttaacatttaaaaagcaattgatataactgtatattaataaaatgaaggggacaaaaattaatagaagtggtaaagca

SEQ ID NO: 29968 - DNA, 472 bp, Homo sapiens
  misc_feature 9: n = A,T,C or G
aatcccagnaattttaaaggttatgtcagtttggtaaaacactttaataaacaggcttttttttccccttctatcagttcattaattttgtaagccatgaatttaacatgaatttacattcaaaaagaattccaacccgttctaagaaacactttttcatgaaaggatggtaaaatacacatatctcgagtttttagctgggaaactcacagtcctagaaatctcacttaatatttcagtgtagcatcatcatgcaatttttggctttataactcactattcttgatctaggtatgacttgtttctctcccattaacatttttttttggcagtttgtttttatgtaaaggtactgttatatataggtttaagatgtcaggaaggccctctgtatttttcattattcctgcaaaataggaaaaaatctatctagggtttatgttaaactgcatgtataaatgtatgcacttca

SEQ ID NO: 29969 - DNA, 299 bp, Homo sapiens
agtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgc

SEQ ID NO: 29970 - DNA, 367 bp, Homo sapiens
  misc_feature 1: n = A,T,C or G
natgcttttaaatgaaggtgggaatagaagcatgaacccggctttttaaatgggaaaataacccagttttgatcttttttagtctgggtgcttactggatgtcaaggtagaaagtgtccaacaaggtgctttaactataggttgagttctcaaaaaggttaagagggtagagttatagtgacatcttcagcatatatagtagttgaggccagtggaagatttcccattgagaatattaagtaataatggaaagatgacaagtgagaaacagcggtgtttttaagggagagtagaagaaagaggagacgccaaaagacggaagtggcttaagtggtaggagagctctgagaggaaagtattttagaag

SEQ ID NO: 29971 - DNA, 456 bp, Homo sapiens
  misc_feature 18, 22, 34, 36, 42, 47, 48, 400: n = A,T,C or G
taagcgcgccatttgtgntggngtcgggaagctncngcattnggctnntgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcantgttcaagagacctatgaagccaaaagacatgagtttccatggtgaacgtcagagg

SEQ ID NO: 29972 - DNA, 229 bp, Homo sapiens
  misc_feature 227, 229: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggnan

SEQ ID NO: 29973 - DNA, 133 bp, Homo sapiens
ggaacaaaacaagggaatcctgattgtgtacagtataaattgtattatattttttgtacttatgttttatgtaaatagtttgtctcattcaattgtatgtgagcattgaaataaatcctaccatttaggggac

SEQ ID NO: 29974 - DNA, 127 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcct

SEQ ID NO: 29975 - DNA, 192 bp, Homo sapiens
aggataatcaggcagtaaaaagaaataaaaggcattcagactggaaaagaagcagcaagactatctctgcgatgacacaatcctggagatagcaattctccccaaatcatttggggatacaatgcaatccctagtaagatcccagctggcttttttcacaaattaacaagctgatcctaaaattcttacgtg

SEQ ID NO: 29976 - DNA, 129 bp, Homo sapiens
atttctagatattgattagtgtaatcgattataaaggatatttatcaaatccagggattgcattttgaaattataattattttctttgctgaagtattcattgtaaaacatacaaaataaacatatttt

SEQ ID NO: 29977 - DNA, 155 bp, Homo sapiens
  misc_feature 117, 137, 151: n = A,T,C or G
aaaattagccaggcatgatggcccattcctgtagccctagctactcaggaggctaaggcaggaggatcgcctgggcccaggagttgaaggctgccgggagctaagatcgtgtcaggncactcccgcctgagccacanagtgagaccctgtntcgc

SEQ ID NO: 29978 - DNA, 472 bp, Homo sapiens
  misc_feature 1, 10, 55: n = A,T,C or G
ntcagttttnataagattatccatttaagccaccaaaggttactttccgcaccanaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctatacaatacggacttctgtgtatatgttatactgattctactctgcttttatcctttggagcctgggagactccccaaaaaggtaaatgctatcaagagtagaactttgtagctgta

SEQ ID NO: 29979 - DNA, 219 bp, Homo sapiens
  misc_feature 13, 103, 105, 116, 129, 147, 153, 168, 188: n = A,T,C or G
tccaaacacaccngtataagcaagtatctagtttcaaaatcatatttgatcatgatgctggaggacttcatagaaagacataaagaactcccttagagaacangnagaagcctacngagaggaatcgcnaaaatccctgaaagaatnccaggnaaacacaagctaacngttgaaggaattaaaaatgnaaatagaagcaatcaagaaagaacacatgga

SEQ ID NO: 29980 - DNA, 230 bp, Homo sapiens
  misc_feature 227: n = A,T,C or G
tcctgcctctgcctcccaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtnctc

SEQ ID NO: 29981 - DNA, 259 bp, Homo sapiens
  misc_feature 2, 4: n = A,T,C or G
ancnttctgcactacatccgcaagtacaaccgcttcgagagcgccacaggaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccc

SEQ ID NO: 29982 - DNA, 160 bp, Homo sapiens
tgcctaatatttatatactcaatgtacaaaattcgaaaaatacgctgggcccagtggttcatgcctgtaatcccaacactttgggaggctgaggcgggaggattgcttgagcctgggcgttcaagaccagcctgagcaacatagtgagaccttgtctatt

SEQ ID NO: 29983 - DNA, 345 bp, Homo sapiens
gaggcggcaacaaaaattttgacagaattgcgccgccttgctcgtgaacaaagagaaaaagaggaagaagaaagacaacgggaagaaatgcagcgaagggtcattaagaaatcaaaagacatggcaaaggaagcagttggaggccaagcagaagaccacttgaaactcaaagatgggcagcaacaaaatgagactaaaaagaagaaaggatggctggatcaggaagaccaggaagcaccactgcagaaaggggacgccaaaataaaagctcaagaggaagctgacaaacgcaagaaagaacacgagagaattatgttacaaaatttacaagaacggttagaaaga

SEQ ID NO: 29984 - DNA, 339 bp, Homo sapiens
ccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacgatctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggac

SEQ ID NO: 29985 - DNA, 464 bp, Homo sapiens
gggctcgtcctgggaacattatggggaggaacggagcctaatcctgtcagcgcagcctggggattaggacccggagttgccaagagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgcacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaaca

SEQ ID NO: 29986 - DNA, 483 bp, Homo sapiens
  misc_feature 2: n = A,T,C or G
antgtgaacagttctgtgatgaacattcttgtgtggacctgcaggtgcacaagaaaaatttctctaggcatacatctgagtgaatttgcttgggtctgctgcattttatggggacattgacaaactgataacgagttcagaggaaggcagttaagaataatttaaccatgtcataaccaacctttgttttccttattttcttagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttct

SEQ ID NO: 29987 - DNA, 412 bp, Homo sapiens
  misc_feature 12, 141, 303, 337, 342, 363, 371, 397, 403: n = A,T,C or G
aggatgaaaatncacataacaatattaaccttaaatgtaattgggctaaatgctccaattaaaagacacagactggcaaactggataaagagtcaagacccatcagtgtgcgctgcattcaggagacccatctcaagtgcngggacacacacaggctcaaaataaagggatgaaggaagatctaccaagcaaatggaaaacaaaaaaaacagggttgcaatcctagtctctgataagacagactttaaaccaacaaagatcaaaagagacaaagaaaggccattacattaacggtaaaaggtntcaatttcaaccaagaaagagctaacttttcctnaattncttttgcccccccattcaggngcccccanattttttaagcagcctttaaaacctncaaaanactttaacc

SEQ ID NO: 29988 - DNA, 227 bp, Homo sapiens
  misc_feature 2: n = A,T,C or G
tntattggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagt

SEQ ID NO: 29989 - DNA, 101 bp, Homo sapiens
  misc_feature 16, 47, 61: n = A,T,C or G
ggatgtgggaggcagntgtacaaaaactgcctcattaacttcttagngaattagacaggcnagaagatgacattcacttagtgatactatgattatgtgtg

SEQ ID NO: 29990 - DNA, 468 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaaggtgacttaaacagcttaaagtttagttaaaagttgtaggtgattaaaataattttggaaggcgatcttttaaaaagagattaaaccg

SEQ ID NO: 29991 - DNA, 235 bp, Homo sapiens
  misc_feature 2, 14, 29, 234, 235: n = A,T,C or G
tntggcccggggangcgttgaggcagccngcgccggggccttctgctgagggggcaggcggagcttgaggaaacccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtcgcnn

SEQ ID NO: 29992 - DNA, 453 bp, Homo sapiens
  misc_feature 10, 17, 27: n = A,T,C or G
aactttaaantattacnaaatttagcnggcacagtggcatgtgcctgtagtcccagctactcaggaggctgaagcaggaggatctcttgagcctagttcacacccagcctgggcaacgtagcgagacctcatctataaaaatttttaaatatcaaatttataaagtattcaaaaataatataatcaatatatcaataatgttttcactgatttttcaaggcagggcaatttttagacacttttgcttttgtattcactatttttcaatttgagtggagttctattattattattttaagttaattagttttcctcagtatagtaagttgactctagtaaaactctaaatcctaaattctcggtcagagtagatattgtcacctattttcaactttgggtagttgagtgaactgttttcttatcgtaaagtattagagtatttttctgaggtac

SEQ ID NO: 29993 - DNA, 465 bp, Homo sapiens
atggccggggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaaga

SEQ ID NO: 29994 - DNA, 159 bp, Homo sapiens
  misc_feature 25, 123, 135, 153: n = A,T,C or G
tatggccgggggcctttccggcggngacgacctacgcacacgagtaacatgcctctcgcaagaggatctccttcatccctctccagaagaggagaagaggaaacacaagaagaaacgcctggngcagagccccanttcctacttcatggatgngaaatg

SEQ ID NO: 29995 - DNA, 436 bp, Homo sapiens
atattataatgaggaatggtactaccgttccgattttctgtaattgcttctgcaaagtaataggcttcttgtcccttttttttctggcatgttatggaatgatcattgtaaatcaggaccatttatcaagcagtacaccaactcataagatcaaatttcattgaatggtttgaggttgtagctctataaatagtagttttaacatgcctgtagttgctaactgcaaaaacatactctttgtacaagaagtgcttctaagaatttcattgacattaatgacactgtatacaataaatgtgtagtttcttaatcgcactacctatgcaacactgtgtattaggtttatcatcctcatgtattttttatgtgacctgtatgtatattctaatctacgagttttatcacaaataaaaatgcaatccttcaaatgtgttac

SEQ ID NO: 29996 - DNA, 304 bp, Homo sapiens
  misc_feature 303: n = A,T,C or G
gggagatggaaaaaaacatgtatgtactcgaagaaaactagggtgaattcctctttaaccttggtgtagagagaatagcttcctaactgtgactcagaatccagaggcaataaaaataaagactgataaatttgacaacattaaaaaaaatttccgctacaaaagacaccgtaagcaaaactaaaagacaactgacaaactaggagaagatattcacaatatataccacagacaaagggctaatatctctaatatatgaagaacccttaaaaattccagggcaaaggattaagaacgtaagcng

SEQ ID NO: 29997 - DNA, 286 bp, Homo sapiens
  misc_feature 7: n = A,T,C or G
tcggccntttattggccgggggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaattca

SEQ ID NO: 29998 - DNA, 327 bp, Homo sapiens
  misc_feature 7: n = A,T,C or G
tcggccntttattggccggggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaaga

SEQ ID NO: 29999 - DNA, 412 bp, Homo sapiens
  misc_feature 12: n = A,T,C or G
tgttccgcaganaggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggcgctgcacttgacgcagtgtgttttaggtgtttgtctttatacttttttgtgatttttgaatgcacgtgcgcaggaagggctcctcttagagaagcagtcaaactgtgaagcactaagctgaccctgcttcaagcaattttgtttttacaactgttcctttcacaagcaagcct

SEQ ID NO: 30000 - DNA, 238 bp, Homo sapiens
caagatagcagtggtctttgctgtcaccaagtgtactgcctagtataggaagtaatcacaaaaacagtttaaatgtaatgttaaggggggtacaggctacagtcagcactcagggcagtgtccctttacctaagaaaggagctggggagggtaagttcaaggacgatttttcagaggaagtgagggattgaccaggcaagtggaaatggaaagaatatttctaggattgcatgctcag

SEQ ID NO: 30001 - DNA, 464 bp, Homo sapiens
  misc_feature 263, 321, 347: n = A,T,C or G
gaggcgcaagaagcaaccgccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgncttcaccttgtataaaaaaggagcggccatgtgggagaccctttctgtgacgggtgtngacaaagagatgatgcaaagaattanagaaaaatctattttacaagcacaagagagagcaaaagaagctacagaagcaaaagctgcagcaaagcgggaagatcaaaaatacgcactaagtgtcatgatgaagggagaaattca

SEQ ID NO: 30002 - DNA, 476 bp, Homo sapiens
atgtgagtgaggaggaggtctgtgcaagtttttgtccaaatgggctggagatttttctatctgtggagccgtgggcatgtctccaggcacaacaccctgtgctagttcccttattggtgcctgccgcttgaattttttcccaggctgctttttatgttatgtggggatgaggcactgacccatgggctgggggttctctggggacccttcccttgctatctacctaatgcaaaatctagctgactcctttcactatgatggtgccgctgcactccagcctgggtgacagagcgagagccctgtctctaaaaaataaaccctaacaaattgacattaaaaaaactgtctaatctgtcataggactgagtttaaaagagaaaaggtggcatggtgcaagtggttcacgcctgtaatcccagcattttgggaggccgaggtgggcggatgacctgaggtcaggagttcaagaccagcct

SEQ ID NO: 30003 - DNA, 130 bp, Homo sapiens
  misc_feature 24, 26, 46: n = A,T,C or G
tatggccgggagcccttgccagantnctggctccagaatttttgcnaggcttacagaacacccactgcctagaggccatcttaaaggaagcaggggctggatgcctttcatcccaactattctctgtgat

SEQ ID NO: 30004 - DNA, 472 bp, Homo sapiens
ggggcattcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatgccgcatttggattggatgaattccaaattctgcttgcttgctttttaatatt

SEQ ID NO: 30005 - DNA, 222 bp, Homo sapiens
gaggcattgaggcagccagcgcaggggcttctgctgagggggcaggcggagcttgaggaaaccgcagataagtttttttctctttgaaggatagagattaatacaactacttaaaaaatatagtcaataggttactaagatattgcttagcgttaagtttttaacgtaattttaatagcttaagattttaagagaaaatatgaagacttagaagagtagcat

SEQ ID NO: 30006 - DNA, 232 bp, Homo sapiens
  misc_feature 6, 21, 29, 30, 31, 58, 63, 69: n = A,T,C or G
tcggcntttatggcccggganggaagaannngctaacctttgaagcaatgccaattantgaanaaaaantaaggatgtgaccgcgtgccctgccagaatgggaggatgggcatttttaccttgccaagtactatgacaaattgatgcccatggtcacagacaacaaaatggaaaagcaaggtgatctcatccggtatatagttcttcattttggcagatctctacaatatgg

SEQ ID NO: 30007 - DNA, 315 bp, Homo sapiens
agaaggagggcagaaaaaggtcagagacttgcccccgagcccgacacacccaacattataacaaaagactgtaacaagggctgtgggagttaggagccaggaaccctggatgaaaaccaatatatatcataacactgcacatagtaacccagttatttttggcccatgaggtgtttttttctctttcctgttctcctggcttacagattctccatcaggctatggggatgagataggaaaaaagaactgttttctttctagtaagggccagtgattcctagcgggtgggatgtgggaacttcagaaccagattgg

SEQ ID NO: 30008 - DNA, 249 bp, Homo sapiens
atggccggggcagcaaagatactataaataaatacaaagataaaaccacaacctaggagtatctgtttggagtgcattaactgacagaatattagaatccaggattaaggaagaaaaagaagcaaatcagtaggaaaaaaacagtctaataaaaatatgggcagttcatagaaatgaaaatccactgggtgataaactttagaaaagataatcaatgacagcacttctcaaaataagacatttacgcgg

SEQ ID NO: 30009 - DNA, 288 bp, Homo sapiens; identical to SEQ ID NO: 24046

SEQ ID NO: 30010 - DNA, 471 bp, Homo sapiens
attctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgttttaaacaacgttaaactcttagcctacaaggtggctcttatgtcattagttgttaatacatccaattaatgatgtctgacatgctatttttgtaggggagaaaaatatg

SEQ ID NO: 30011 - DNA, 385 bp, Homo sapiens
  misc_feature 283: n = A,T,C or G
gcggtgggtgtcatcaaagcgtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagtntttaagttattaagttttttaaaatcagtactttttaatggaaacaacttgaccaaaaatttgtcacagaattttgagacccattaaaaaagttaaatgagc

SEQ ID NO: 30012 - DNA, 441 bp, Homo sapiens
gcttttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgagggatgaagattcaccaaataagctatatactttggttacctatgtacctgttaccactttcaaaaatctacagacagtcaatgtggatgagaactaatcgctgatcgtcagatcaaataaagttataaaattgc

SEQ ID NO: 30013 - DNA, 158 bp, Homo sapiens; identical to SEQ ID NO: 29724

SEQ ID NO: 30014 - DNA, 125 bp, Homo sapiens
aatttttcttatcttgaagttccacaaagtggagaatatttatattctcacatgcattttaggcacttttgatatgtgaaaatagatgtattttctgatgcatttggttaataaatattaatctg

SEQ ID NO: 30015 - DNA, 231 bp, Homo sapiens
  misc_feature 21, 28, 29, 32, 52, 56: n = A,T,C or G
atcttttttacccagggaaanctcggcnnttntggccccggggtggtggccnagangctggaggtggagggaatagggagatgtttttggttacagggtttcaccatgggttgatgaaaaaattctggacgtggatggtgatgatagttgcaccacaatgtgaatgtacttcgtgctatagaactagacacttagttcaataccagcctaggcaacgtagtgagatcatgc

SEQ ID NO: 30016 - DNA, 242 bp, Homo sapiens
ggtgagctgagatcgtgccattgcactccagcctgggcaacaagaacgaaactccgtctcaaaaaaacaaaaacaaaaacaaaaacaaaaacgagccaggtgtggtggcacgcacttgcggtcccagctgcttgcaaggctgaggcggtagaatctcctgaatccgggaggcggaggttgcagtgagttgggatcgcaccactgcactccagcctggcaacagagcgagactctgtctcaga

SEQ ID NO: 30017 - DNA, 462 bp, Homo sapiens
gggagcagacaacaggagtaaagcagcatcttgcctggatgagccaggggacacagcaagaagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataactgaaatcaaagatggagactttaagaacctgaagaaccttcacg

SEQ ID NO: 30018 - DNA, 406 bp, Homo sapiens
  misc_feature 26, 364, 371, 372: n = A,T,C or G
atggatggaagcaaggagagaaagangattgatcttcgtggggatggtgaggctgagtgtggcatcacatgatgtcgaagggtctcacaggaggaaggtggaggagggtcaaggaagtgggaatttcgaaagtcattgaaaaattgcggaggaataagactgatcacagaagtaacctatgaaagtaaaggaatcatataatgtgtactcttttgtctatttttttcactcatcagaattactttgagattcttgcatgttgttttatgtatgcatagttaatcctttttattgctgaacactattccattgcatggatataccaaaatgtgtttattcattcacttgttgacaagcatttgtntttatgnntttttttgctattacaaataaaacattcatctgc

SEQ ID NO: 30019 - DNA, 480 bp, Homo sapiens
  misc_feature 12, 27: n = A,T,C or G
agctgtaaaagnatcctatgcgaaagnacactggctcttttttttaatcccccaaataaattttgccccctttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaagaggcatatatttttcaaagaagtgaggatgcagtttctcacgttgcaacctattctgaagtggtttaaatggtatctcttagtaacttgcactcgttaaagaaacacggagctgggccatcgtcagaactaagt

SEQ ID NO: 30020 - DNA, 457 bp, Homo sapiens
gtgtgtctgtgtgtgcgtgttttaattttgacttcataagtactctagttatgagcttatttaacattgggttttactaataggggtatgtgttgagaaaatttcaaagttttagaatatggttcacccacatgttgcttccctgtaaatataattttcaaaaccagattctgggccgggcatggtggctcacctctataatcccgaaacgttgggaggccgaggcaggcgaatcatgaagccaggagtttgagaccaggctgaccaacacggtgaaacccagtctctactaaaaatacaaaaaaaattagctgggcgtggcggcaggtgcctgtaatcccagctactcaggaggctgaggcaggagaattgcttgaacccaggaggcagaggttgcagtgagccaagatcgcaccattgcactccagcccgcgcgacagtgtgagactccatccca

SEQ ID NO: 30021 - DNA, 322 bp, Homo sapiens
gacacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagcttgctgtgcctgatgccaggacagctgtgctctcagatgtaaatagagcaacctatataacctggattttttttttt

SEQ ID NO: 30022 - DNA, 101 bp, Homo sapiens
  misc_feature 41: n = A,T,C or G
tatggccgggagttaaggactctggcaggaagtctcaggcnaaggatgtcattgaagagtatttcaaatacaagaaatgaagaaataaatctttggctcac

SEQ ID NO: 30023 - DNA, 201 bp, Homo sapiens
  misc_feature 11, 19, 42, 43: n = A,T,C or G
tccccgggaanctcggccntttatggcccgggcaagggaganngttattggatttgcatgttagttgaggagcccaagatggataggccctttcttctgttgccatctgactgctcagggctggagtgttctgtggtcttctaactctcctgcttgcttcaagtgttatatgtggtttgccaggatgatatgaacttggat

SEQ ID NO: 30024 - DNA, 441 bp, Homo sapiens
  misc_feature 372: n = A,T,C or G
caggctcgagtgtaagggcacaatcagctcactgcagccttaacctccagggctcaagtggtcctctcacctcagcctcccgagtagctgagactacaggcacatgccaccatgcccagctaatttccatattttttaatagagatgaggttttgccatgttgcccaggctggcctcaagctgaactcaagcgatctgcctgcctcagcctcccaaaatgctgagattacaagcataagccactgtgcccagccaactttatgatttaaaaataacatgtttatgtttttaaagccataaaaccctgagaagaatacatagagataaatcttcatgaccttggatttgtcaagtggttttagatatttgggntccttaggcaccaaaggcatgagcaacaaaagataaactggacttcatctaaatgaaaactttttgtgc

SEQ ID NO: 30025 - DNA, 471 bp, Homo sapiens
  misc_feature 163, 236, 309: n = A,T,C or G
catttaccttattaaaatgaaagtgccatacttaacttttaaaggaaagacctgacttgctttttctctatttagactgtttttgtactttactaatctttaaactatcaggaaaaaaaccaaaactttataccaatgatttagtaattttgaggcatagggnagcttacgtagtggaggatgtgccaaatattctcttcaaatgccaccttctcaatttataactaaaatagtgntatctgactaattcctctgaattttgatgtaagatctatataggcccccaaaatgatcgtagtacatgccagncatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcat

SEQ ID NO: 30026 - DNA, 465 bp, Homo sapiens
ctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatggtgatgataacctccccacccaggaatatattatgtggtttgataaggtttatttttaacctctggcaagccaccaacgatagtatgcagcat

SEQ ID NO: 30027 - DNA, 464 bp, Homo sapiens
atggcagaagaagtaatgaaaaattttggcagtttttggaaactgtgcaagaattagcaatttataagcaaacaggtaggtgatatgtaaattttaacttgtaagatttgtatttatgtacacacattgtaatgtttattattttttaatggtaatggttaagtgtgaatgcttcactgggttagtaaatccgaacattaaatttgaaaatatgttttaatagaaaccattctaagcatctgtttccaaaaatacaaggttttaatgctttattataagatacctcatataattagtcatgtttggatattgcattctcatcaagaagaaatcaaaattgttacctgggcatggtggtgtgcatctgtagtagcagctacttggaaggcccaaggccagaggattgactgcttgagcccaggagtcagagactagtctgggcagtatagcaagaccctgtttct

SEQ ID NO: 30028 - DNA, 163 bp, Homo sapiens
gtacgactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgt

SEQ ID NO: 30029 - DNA, 232 bp, Homo sapiens
gaagctgaggcaagcggggggtggatcatctgaggtcaggagattgagaccagcctggccaatgtggtgaaaccccatctctactaaaaaatacaaaaattagtgggacgtggtggcaggcactactcaggaggctgaggcaggagaatcgcttgaacctgggaggtggatgttgtggtgagctgagctcacaccaccacactgcaagcctggatgacagagcaagactcac

SEQ ID NO: 30030 - DNA, 249 bp, Homo sapiens
ggagcgaagcaattggttaagctgtagcagcttttttgtttatttttttaaagtaataataaaacctgaactgaaaaaagataaaacttgaactagaatactactcttgtatgcttagaatgtttatagtgttaaatgtttatgtggggttgtcaacatttttattatttatagttgaattatgttttgttaaatccatattgtttattatttttatattttgaaaatttttaaaataaaagtcttacg

SEQ ID NO: 30031 - DNA, 180 bp, Homo sapiens
  misc_feature 14, 20, 32, 44, 47, 48, 57, 153, 164: n = A,T,C or G
ccccggccttgggnccgttngttttttttttnccccttcctttnggnnaccgggggnaaacttccccttggccttttccttccccttttggccccttcccggaaaaaatggggacccccccaaactgggcttccctggccttcgccctggttngggcttccctngtggcccttgtggccc

SEQ ID NO: 30032 - DNA, 360 bp, Homo sapiens
  misc_feature 4, 5, 45, 48: n = A,T,C or G
tacnntgtggccggggatttccggcggtgacgacctacgcacacntantaacatgcctctcgcaaaggatctccttcatccctctccagaagaggagaagaggaaacacaagaagaaacgcctggtgcagagccccaattcctacttcatggatgtgaaatgcccaggatgctataaaatcaccacggcctttagccatgcacaaacggtagttttgtgtgttggctgctccactgttcctctgccagcctacaggaggaaaagcaaggcttacagaaggatgttccttcaggaggaagcagcactaaaagcactctgagtcaagatgagtgggaaaccatctcaataaacacattttgg

SEQ ID NO: 30033 - DNA, 310 bp, Homo sapiens
gggggctgtacatggtgtgtggctgcaatactgatggcctgttttgttctcctggggagatactgtaaggcacagtggcagattcacctgaagctcatttttgccccccaaaatttctccccattaatttttccagtttgaaattctctaggcatacaagatcttttagagtgtaaatgcacttcaagagaaaatacaaaaacagaacacttatgaaggaagactttggtgtggtgtcatccccattctgcccttactgtgtaatcttgaacagatccctaaacttccctgaatctcagttttctcatcc

SEQ ID NO: 30034 - DNA, 244 bp, Homo sapiens
  misc_feature 27, 244: n = A,T,C or G
cagataaaagaaactcctccgcacagnacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccan

SEQ ID NO: 30035 - DNA, 395 bp, Homo sapiens
  misc_feature 304: n = A,T,C or G
agaggaaggtaaatgtattttgcaatgggggcaaggaggatgtgaatctttgggagccagaaggcagactgtagtaggcaaagttctaaaaacaaccccgccttgggccgggcagtatggctcatccttgtaatccaagcctttgggaggccagggcaggaggatcgctttgagcccaggagtttgagaccagccttgggcaacagagtgagaccttgtctctatgaaaacaaaacaaaaaaaaactagccagccatggtggcccttgtctgtggtcccagttctttgggaggctgaagtgggnaggttcactttgagccagggagatgatgactgcagtgagcttgtgatcacaccgctgcacatcagcctgggtgacagagtgaaacctccgt

SEQ ID NO: 30036 - DNA, 155 bp, Homo sapiens
  misc_feature 71, 83: n = A,T,C or G
gttgcaaagttttcacgtcattgtttcctggctagttcatttcattaagtggctacatcctaacatatgcntttggtcaaggntgcagaagaggactgaagattgactgccaagctagtttgggtgaagttcactccagcaagtctcaggccaca

SEQ ID NO: 30037 - DNA, 196 bp, Homo sapiens
gggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagc

SEQ ID NO: 30038 - DNA, 448 bp, Homo sapiens
gcaggtgctctcaagggtgaggctgccgtctcacgactgacggctttatataggattcacgaatactcaggaattttccctagggaagttcattctcaacctcaccattctgttctggcagggcatgttaggatcttatgtctttgtaaagctttagaatctctcatggaaataatagcagttttatagttgagaataaacagtcgggcgccgcggctcacgcatgtaatggcagcactttgggaggcagaggcaggcagatcacttgaggtcaggagtttgagaccaacctgacaacagaaagctctatcaggcaactgcccataatccaatttgggtatagcctcggggccttaaagagaatgcagtgtctttgtcagttaagcctttacaattaagaagtggttaattgggtttttaaccaattagcctgtacaattaagaagtg

SEQ ID NO: 30039 - DNA, 471 bp, Homo sapiens
  misc_feature 13: n = A,T,C or G
ctcctcttaaacnccgataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggatttttgctttttgctgtccacaagagctggaggtctagggattaaatttagcctctgctgacactgttgttatattttgattcccgattgggaatccacagaatgatcttcaggcacaggctagagcccatcgaattgggcaaaagaaacaggtgaatatttatcgtctagttacaaagggatcagttgg

SEQ ID NO: 30040 - DNA, 128 bp, Homo sapiens
agaggaagaatgagatgttatgtaaagcaggatctctaacctaccttccttctaaaaatatgtgagatatatatgaataagaccatattactacagtaagaccaacaaaagacatataaaaagacaac

SEQ ID NO: 30041 - DNA, 473 bp, Homo sapiens
gtaacaaaatgacaggacaatcttgcagtaacactttccccttgaagagaagggggttttgattgtgatatatactagtatctaggaatgaacagtaaaagaggagcagttggctacttgattacaacagagtaaatgaagtactggatttgggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagcttggcagtgttcctgccccagcatggcaccttattgttttgatagcaactttcgttgaattttcaccaacttattacttgaaattataatatagcctgt

SEQ ID NO: 30042 - DNA, 467 bp, Homo sapiens
  misc_feature 408, 453: n = A,T,C or G
gaactcggtggtggccctgcgcagaccagacttcgctcgtactcgcgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggnggggaaggaaagaacttgcatgttggtgaaggaagaagtgggggnggaagaagtggggg

SEQ ID NO: 30043 - DNA, 476 bp, Homo sapiens
gaggcattgaggcagccagcgcaggggcttctgctgagggggcaggcggagcttgaggagaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtgatt

SEQ ID NO: 30044 - DNA, 125 bp, Homo sapiens
ggtttcatgtttttgtattatgtatctttttgtatggtaaagactatattttgtacttaaccagatatatttttaccccagatggggatattctttgtaaaaaatgaaaataaagtttttttaat

SEQ ID NO: 30045 - DNA, 473 bp, Homo sapiens
  misc_feature 17: n = A,T,C or G
gttgcagtttcaaagtnagaggaatcgtgcttcggatttcttatgttttctagttctctgtttttccagttcacagtgggttggggtgcattcagtagtccatctttggggaacggaggcgtacttgccattgattcacatgactacatgaaattctgtactgtcatttcccagatgtttggccacagaaactttttcccacttaacatttgttaacagcctgcaaaactaaacttgtacatggcagtggttcccagacttttgtattttatggaccggtagtaatatttccaaaaatctggggtactataaggttgccaatttaccttgccaagtaatccgaataaatcactgtattatcaccatttttttcataaaaggaaaggacaatctatctctgaataagaggagtcctttaaacggaatgaatgtggcttttgggggcaaaagaaaccaagacactacattgtctt

SEQ ID NO: 30046 - DNA, 471 bp, Homo sapiens
  misc_feature 3, 6, 13, 19, 27, 333, 341: n = A,T,C or G
atnctnaagattncttttntttttttnaagatggtggattagaggcttttagcatttttcagccacctggaaacagaaaaatagtgcatcaagatcaactctgtgagctttcattcaagaaaaaaaaaatagtaatccgctggaatcatgaaggacatcctagatcttagggagaagaatatggacaaacaacctccatggcagtgtctagctgataaaaggagtgtgttgaggcacaaccatcctcaccccacaccaaggcagatcttcaggcattcagggcatctgtttatccagttacagcctgaggcacccctctcatcctgtgcaganaatttggngtaagtgtaggagccccctacacttcatgcccaggaaaatctccacacatctggcgtacccattctcctggattttgagtttaggctaccttcacttcccatgcagagcaattggggccaaggagttttc

SEQ ID NO: 30047 - DNA, 272 bp, Homo sapiens
  misc_feature 15: n = A,T,C or G
attggccggggagangaagctttgctcattcgcctactgctcacctcctgttgtgcaggaggtctgtagccccaggggttgggaacccctgctctagagcttaataatcaactggtggagaccagtgcaattgtaaacaaaagtgacaaaacgatagtaataatgccaatggtaatgaaagctacagacattttcagagtgctgtgtctccaagtactgagctgagcactctgcactcatgaaatatgtatcctcctcacacacacacacgc

SEQ ID NO: 30048 - DNA, 100 bp, Homo sapiens
  misc_feature 6, 11, 19, 20, 47: n = A,T,C or G
tggcantgaancctggganngtgggaggttgcagtgagcccgagatncgcatcacttgcacctcccagccttgagagtcagagtgaagaactcccgtcgc

SEQ ID NO: 30049 - DNA, 471 bp, Homo sapiens
  misc_feature 14, 26, 458: n = A,T,C or G
ggagcctttaagangcatcctctgcnagaccaaagaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagacntttagattctatt

SEQ ID NO: 30050 - DNA, 225 bp, Homo sapiens
  misc_feature 3, 14, 32, 41, 47, 56, 64, 96, 101, 125: n = A,T,C or G
aantgggtgggaantttgcaggaaaagaagtnagcagagangtaaantccctggangtttaccngggtagttttggctttgatagaggtcagaagntcaantactacctttagttgttccctctntaccctcatagttgtgcccctttggccctgaatgttggagcagaaatgatagacatcttgggttgatctagggtgagggtgttgctatgtgagtggaaca

SEQ ID NO: 30051 - DNA, 208 bp, Homo sapiens
  misc_feature 6, 11, 42, 74, 111, 147, 162: n = A,T,C or G
tacctnaaccnctgatgtgccctagtagacccagcaagagcnaattacctacctcgttctgggcagacccttantcccaaagtctggtacaacctgtcccttagacctgantgagccaaaggaggaagtcaacctaactgaaagaantgaactaactaaaanttttgacacctgaaaaacattttattaataaagaatattgacatgg

SEQ ID NO: 30052 - DNA, 497 bp, Homo sapiens
  misc_feature 10, 13, 27, 28, 36, 42, 44, 60, 63, 73, 74, 270: n = A,T,C or G
acctcggccnctntggcccggggaccnnagtccccncctagncnaccctgttttgtagangantctgaagaannttcaaaccacttggtacttaacactgtgaagttggcaagacttctggatcaaggtcagtgtacaaagtttaacttactaaactttactgtacccagtaacacttaaaaaatttaaaaggatacaatttctaataagcatcagagataacaaaaacttctaataatatcaaaagtaaaattatggtcaattagttanaacacatcagttttattcttttgcctattttaattttttgattgtatcttttatttgatgtttaatacttaaaatattttaaaaatgtgagcaagtgtatctaaatatttgtatgcatgtgtatcatataaacaatattttatacatctttcctctctttgtgtttttcacttgtatcctagaaatcagtctgtagcagtgtattactccattgtgtgggatgtaat

SEQ ID NO: 30053 - DNA, 472 bp, Homo sapiens
  misc_feature 1, 2: n = A,T,C or G
nncttaggaaaagttgttatatctgaattacctgtgccaagccagataaaatgtataatctagtttactgcatttccggtggtaagaagagagctgttttatataatactgcttctgcctctgatctgaatatatccagcctataggttcaaaatcaatctcttaccatcaaaaggagaaaggtactcaaaaatatgaggaaaacactttttaatgataatgtatttacaatataaatgttgtattacatctatattaaaaaagtagaagctattacttttgtttttaatgataactatgatttatttattctggctcaagagccttcgcttcgaaaatttggtaaatagtaatgtttaattgtatcatggtataatttaacattttaatacaatttaactaatgtcatatgtttttacaatccaagagcaattttttgtactaacttatcatagcctgtgcttttattttt

SEQ ID NO: 30054 - DNA, 393 bp, Homo sapiens
cagtaagtctaatgtaagtccttttattttaccctttctttaggttctgcccttgtatcttagaataacgaaatatgaagtgaaatttggtgtcatggtttacctgtagccattttataatttagattcatgggtttacattacttactgaaactactggggaaacattaacaacacaataggattcctagattgataaacttcaacactcaagctatgacagttgttctcagtctcgtctttgattcaatgtaaaaatttggacaagttaattagctttcttttgctgcgtgtataggggcaggataaacttgagaattcccacaattattcaacccagatcaaagatatttgtctcaggaaatcaacaatattaagaaaaatggctttttg

SEQ ID NO: 30055 - DNA, 242 bp, Homo sapiens
  misc_feature 4, 7, 30, 31, 32, 37, 45, 51, 56, 60, 74, 98, 104, 124: n = A,T,C or G
aaangangccctagtaacttgccctaagannnactcntttctctntacccngttantttntcaactttttcccnagtactttttctaccggaaaaaanttgtanttgaaaaaccactttagtantgcagttgataaagaaggaatttggtataattatggtgggtgattattttttatactgtatgtgccaaagctttactactgtggaaagacaactgttttaataaaagatctacattcc

SEQ ID NO: 30056 - DNA, 111 bp, Homo sapiens
  misc_feature 12, 38, 41, 53, 60, 63, 74, 86: n = A,T,C or G
attataaaagtngctggggatggtggcacacacctgtngtnccagctactcangaaggtngangtgggaagatngcttgagcccangagtttgaggttagcacgtagagct

SEQ ID NO: 30057 - DNA, 130 bp, Homo sapiens
atacagaatcgggccgggcacagtggcttatgcctgtaatcccagcactttgggaggtcgaggaggtagtatctcttaaacccaggagttcaaaataagcctgatcaacatagcaagactctgtctttac

SEQ ID NO: 30058 - DNA, 472 bp, Homo sapiens
  misc_feature 56, 79, 134: n = A,T,C or G
gtggaaattaaggatgtgaaactacctgtgcagcctgcagagcagctatggctgcngaagcagaagcgtcccgcgaggnccgccgccagggttattgcatgccgaagaagaaatgaatgcgtccagggctctgnaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagatt

SEQ ID NO: 30059 - DNA, 411 bp, Homo sapiens
aggggagagccaggagaaagctgctcctaggggtgtctcaaaggaagaagggctctgcagtgtgaactctgcagagggcagggagaatagaggttaagcctttgctcattctgaattaattgattactgctttttaaaagtgctttctttctctgggaaaaaaaacattccccagtgcctaaggctaacagacgtgggcgctgagctgtgtctggtctgctgagtgtattttccacagagcaatcctcatcttctcagggggtggggggatttggacaagactcttcctgaacacgcagcgtggtgggggaaagggtggccattgggaggtttttctgttccttctgttgtcactggtgaaagacgacttggtgcccaatttctaataaacacaatgctattagcgtcact

SEQ ID NO: 30060 - DNA, 164 bp, Homo sapiens
  misc_feature 3, 13, 27, 47, 105: n = A,T,C or G
aanaggacttccnttgaaagcctgtanaaataagtgtttctcgggcnttctgtctctactgagaagaaagcttacttacctctgatacctctttaatcttttacnaaaggcaagttgccacttgtcatttttgtttctgaaaaataaaagtataacttattcac

SEQ ID NO: 30061 - DNA, 472 bp, Homo sapiens
ggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatccca

SEQ ID NO: 30062 - DNA, 350 bp, Homo sapiens
  misc_feature 6, 7, 166: n = A,T,C or G
tcggcnntttatggcccggggcccttgttctgaactgtttcgcttctgactgttaaacaccgatgacgcatgcacctgcacttcttcgttttcttcttgctcccccattggcctgagtttcttgtgcattactcctctccctccttcgttagaataggtatatcangctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctatttagtaggtatttggttcaataaatacgcaagctgct

SEQ ID NO: 30063 - DNA, 472 bp, Homo sapiens
  misc_feature 4, 280: n = A,T,C or G
agcngtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggnaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcagcaactttcccatctt

SEQ ID NO: 30064 - DNA, 473 bp, Homo sapiens
  misc_feature 466, 471: n = A,T,C or G
acctgaagcaccaaagctccccaccccagcctggtggcagaggaagcaggtggcaccaactcaccaaagggacttgggagccaccttctcactctgtggaagtactttagtgagagctgactggcaagataaaaaccctgaaattcccagaagttacagatgccttaaagactttctttggaagatcattgcctgtactattccttttttgtgtggcataaataatatattaacctgttacaactgacaacattggttttctgcagctagggagtcttgagtcgagactgctcgccttgatgacttgctcttttttggcagatgtgtgggagttggctgttacgacatccctgtgtgatcccagaggaggggcagtagctgggcagaaactgcaggcacacatttgggtggatcacctggcttccagccccttcggggtggtgctcagtgtgggggtgatggtatnattanag

SEQ ID NO: 30065 - DNA, 120 bp, Homo sapiens
aactgaagtgtctgtacggaatgccctttgctagccatgggctggtcaccagattgttttgtaatgcccgccccttgcctcgatattgccagtttcttgtgcaataaacaatcagcagct

SEQ ID NO: 30066 - DNA, 280 bp, Homo sapiens
  misc_feature 2, 4, 9, 15, 18, 22, 32, 44, 54, 78, 90, 161, 182, 208, 210,251: n = A,T,C or G
cntnaaacnggcctnttntggnctctgcagtngaagcaggggtncaaaaatctnagggtcacctagtagctgcaggtnttgcgtagagtnagtgccgtttataacaaagcctttgcaagttccttgcttttaacagtgttgaaagataatcttattaggcnattagattgattgatcactanaatgttttttaaaaagagctcactgngnaacttagagctcacagaattgggtgacagtattacaatagnaactccttttccatctacttgtgaaggtt

SEQ ID NO: 30067 - DNA, 472 bp, Homo sapiens
  misc_feature 78, 149: n = A,T,C or G
agtgaccccaacacacactcccactcccagcagtggaaatagatgtgcagggcactcctggccttggcccatcctgcncactttcatcttgataccaactgccaggcaggccactgagttaggagtggtaccatacgagggagcacagnggtatagcatgagagagagtgaggaggaggatagctgtgttctacattttaggcctttcttgactctaaagcaaccaagcttctagaacaagttttattattcttatttcacaaatgaccaaaataagattaagagggagggttagtaactagtgaagggatccaagacttcaattctcaggttgatattctttcctccatataatgccaacctggggtctttgcccattctgaactactataacctgccctggtcgttcagacctttcttcgacagaatggtgttcaagactagcctgggcaacatagtggggtgcattaag

SEQ ID NO: 30068 - DNA, 472 bp, Homo sapiens
  misc_feature 79: n = A,T,C or G
aacattgagtctctaagattttggatggcagtaagaattaaagtggtttctcttccttttgttaagcaccgggagtttngttggaaaacacatttgaaacttctcttgggtaggaaactgggctgggcacttctcaggcctacagtttggtttgccagagcacaaacagcacagtgatttaaagtcttccatcctctttgaactgcttatttagaaaattcaggttttcaaggctcccagaaccgtgggcctggggaccgtggggtaagaggtgtcactgacagcacaaacctcgggctgcttggagctctggtattgttcatattcaggcatctctggagcttgtgacagctttaccagccgcgtgggtatcctggcatttcagaaacccgagccagtgagccacccctacttggccttgacattgagttaaaatttcagtcagtttgaaagcaaacctcaaatgtccttc

SEQ ID NO: 30069 - DNA, 470 bp, Homo sapiens
aacatctgaaagcaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagattacaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtga

SEQ ID NO: 30070 - DNA, 332 bp, Homo sapiens
  misc_feature 37: n = A,T,C or G
atagttataagaaataactagacagcaatcactaatntagtccatgttttaatttagcatcggggttggcatatatgttgtttgctaataactgagtagagaatagttgccaatttccacactataatatatgttgcagccgagcacagtggctcgctcctgtgatcccagcacttcaggaggctgaggtgggagaccaggagcttaagaccagcctgggcaacatagcgagattcctctccacaaaaaataaaaaaatttcaaaaagagagataatatttcatttgaacttctacagttagaaaaaaaatgctaaattgtccccccccccc

SEQ ID NO: 30071 - DNA, 473 bp, Homo sapiens
  misc_feature 151: n = A,T,C or G
gaaatgaaataatgaaatgagatgaaataacgaaataaaattgaaatgagatgagaggaaatgagatgaaatgttgaaaagaaaggaggaaatgatgaggtgagatgaaatgatgagatgaaatgaatctgagatgaaatgagatgaaaantgatacgaaaaatgatataaaaaatatgacctgagatgaaatgagatgaaaaatgatacgaaaaatgatataaaaaatatgacatgaaatgaaatgagatgatatgaaatgacataatgaaatgatgaattgatgatattgaaatgaaattgaaagatgagatgaaatgatgagatgaaatgaaatgttgaaatgatgaagagatgtgacatgaaatgagctgaaatgagatgaaatgaaatgagattaaatgatgagatgaaaaatgatgagatgaaaaatgagatgagatgatgagatgagatgagatgaattgagatga

SEQ ID NO: 30072 - DNA, 321 bp, Homo sapiens
atcctgataccatttaacactgtctgaattaactagactgcaataattctttcttttgaaagcttttaaaggataatgtgcaattcacattaaaattgattttccattgtcagttagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattc

SEQ ID NO: 30073 - DNA, 473 bp, Homo sapiens
  misc_feature 437, 463: n = A,T,C or G
catcagggtagatgttttatgtttattactgtacttgtgtcttcatgtctttggtctaagacattgttcttcctctaaatgttctttatctctgttccttctcatatccctcactttttatttgctgtgattatgaaaagtaattttcaggtttacaaaatatgtggtatacacttaatgtgcaatgttttcatgcagctttgtctcagtggggccaaagcacatcagaagccttctttgtgccacatgcggtggctcacgcctgtaatcccagcactttgggaggccaagacaggtggattgctttgaggtcagggagttttgagaccagcctggccgacatggcaaaaccccatctctactaaaaatacaaaaattagctgggcatggtcggtgcgtaccttgtagtcccagctactcatgaggctgaggcatgnagaattgcttgaacccaggaggcaanaggtttgcag

SEQ ID NO: 30074 - DNA, 471 bp, Homo sapiens
cacacaataatagtggaagactttaataccccactgtcagtattagacagatcaccgagacagaagattaacaagatactcaggacttgaactcagctctggaccaagtggacctgatagatatctgcagaactctccaccccagaacagcagaatatacatttttcttggtgccatgtggcatttactctaaaattgatcacataatttggaagtaaaacactcctcagcaaaggcaaaagaactgaaatcataatagtctcccagaccacaggacaatcaaattagaactcaagattaagaaacacactcaaaaccacataattacatggaaattgagtgacctgctcctgaatgacttctgggtaaataatgaaattaaggcagaaatcaagaaattctttgaaactaatgagaccaaaaaggcagtgtaccagaatttctgggacacagctaaagtatggtaagaag

SEQ ID NO: 30075 - DNA, 360 bp, Homo sapiens
  misc_feature 145: n = A,T,C or G
gtatctaacgcattgaatggtcctgggcaagtcattgaacctctctggattcgttccattcctctgtaacattaaagaattacactagacagccatagggcccctccccgctcctgttttcccatgtttccatgaaatattttcnggtggaagagagtagagtatgtacttagatgagaatataaacttagtttgcaactaatttttcagttgtattttttaagtttctatttgagaattttgtttagtgatataaacacccctctgagatctctgtactatcaatttgcctcaaaaaaaaatacagaggtaaattcagcttagtgcattcccaaaagatcataaattcaacattagttc

SEQ ID NO: 30076 - DNA, 472 bp, Homo sapiens
ggcagaagtccggagttccggctctgaactggagctccccgccattcccgggccctccggtttctccctcaggccatctgaggaattgagagaaagggtgaatgcctctcgagaagtggagccagtagaacctgaaaactgccaccttattgaggaacttgaaagtggctctgaagatattgatatacttcctagtgggctggcttttatctccagtggattaaaatatccaggcatgccaaactttgcgccagatgaaccagggaaaatcttcttgatggatctgaatgaacaaaacccaagggcacaagcgctagaaatcagtggtggatttgacaaagaattatttaatccacatgggatcagtattttcatcgacaaagacaatactgtgtatctttatgttgtgaatcatccccacatgaagtccactgtggagatatttaaatttggaggaacaacaacgttctct

SEQ ID NO: 30077 - DNA, 471 bp, Homo sapiens
  misc_feature 395: n = A,T,C or G
gtatgacacggtgaaccagagcaaaacccctttcatcacgcacgtggcccccagcacgtccaccaacctgaccatgacctttaacaaccagctgaccactgtccacaaccaggtaagtgggaaacagaagggaaggagaggcggggctgcacagtgtgagcctcaggacttgtattttccatcatacctagtcaggaggcaaaattcctgctgtcatgttcaacaactaaacaaagtatttgcatccaaggttatttcctttgagggacccaggcacattttgtgttgacttctggccccattgacaggtcccagaaaggactggtgagggccattctttctgagatggttccccttactgctttcctctgtcctgatgtgggaatagggggggnaagggggggggcttatgatccctttttatgcctgatatgtgcctggtaaagaattctagaactggccaggcacagt

SEQ ID NO: 30078 - DNA, 106 bp, Homo sapiens
atacaaaactcgtttacaagggaacaatctatacctttctaaaagttaatatttcaagtctctaataggcagaatattttactctttaaaatcctgcctttctgac

SEQ ID NO: 30079 - DNA, 463 bp, Homo sapiens
attcgctactaaatgcagactggaggggaccaaaaaggggcatcaactccagctggattactttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacacagcataacccgtttctttgaggagtgtgaccccaacaaggat

SEQ ID NO: 30080 - DNA, 472 bp, Homo sapiens
  misc_feature 10: n = A,T,C or G
aagataactnatgaccttgctcgcattttgcagaatcacagatcatggaacaagatgctgggtaggtcattttgtctagatctttgtctcataggagcaagcagttaacgtctccattttaaaaatgaggcaatagttgctcagcaagagtaaatgaagtactgctgctgggggaggcatggaccagtttgaggagagaacccaggctctcagcaagcaggtcttctcacttcaccactttgcttcaccgagtctcagtttcctcatctctaatgggcactgcaagtatggattaagcatggtatttagagcacattgagaaatctctgcagggtgaatgattaaatgtaatgctgataagttacatttttatatggcactttataatttacaaagtgctttcctctgcattgttttattttgctggtgcctcattgagttgcgtaagcagtaggattccttctccacttct

SEQ ID NO: 30081 - DNA, 492 bp, Homo sapiens
  misc_feature 3, 13: n = A,T,C or G
ggncgttcccctngtaggcgtagacgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatg

SEQ ID NO: 30082 - DNA, 177 bp, Homo sapiens
gaagtcctgttagcttctcagaaaacagatgcagaagctacagaatacagaggctacagaaacataaatgagctgactttagtgagcatagcagtgggaacaaggtcaaggtccttttgaaacactgcagcgatcttaattttgttagatttggagttcaataaatggagtatcctg

SEQ ID NO: 30083 - DNA, 270 bp, Homo sapiens
  misc_feature 21, 269, 270: n = A,T,C or G
ataacacatttgttttaaacnttttggtactacgcatccccatcattgaaatttaccaactcttatttcttaaagtctttgggctttaagataattcataattgaaaatcattttgttaacaacaacaaatagaacacctcttaggagggcattatggtaggtgttgtagttgcctctgccttgtgatgtttataggtaaaagctcaaatcccagacttggcagctctgtaacctctggaaaatcaaaacaaagactgtgtaccccccnn

SEQ ID NO: 30084 - DNA, 529 bp, Homo sapiens
  misc_feature 11, 14, 29: n = A,T,C or G
caatcctcacnacncttacaacaattggnctcccccagtgcaaagcattgaaacgtccaatggttatttcttggagagatcacatagtgctaggatgacacttgcaaaagcttgtgaactctgtccagaggaggagccagatggacccaagatgctccagatgaacatgagtcgcctccacctgaagatgcccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtgggagaaggttattcacttgtcttatctgcagaaatttgctg

SEQ ID NO: 30085 - DNA, 406 bp, Homo sapiens
  misc_feature 331: n = A,T,C or G
gggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggcttggatgtctccatctctgtctcaactttacgtgtactgagctgcaacttcttacttccctactgaaaataagaatctgaatataaattttgttttctcaaatatttgctatgagnaggtttgatggattaattaaaataagtcaattcctgggaagttgagagagcaaataaagacctgagaaccttcct

SEQ ID NO: 30086 - DNA, 468 bp, Homo sapiens
  misc_feature 6, 13, 458: n = A,T,C or G
attgtnatgaacntcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattgggtgaaaacatgaatccagatggcattggttgctctattggactaccgtgaggatgggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgattattttggggggggggangcctttggtt

SEQ ID NO: 30087 - DNA, 155 bp, Homo sapiens
gactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgc

SEQ ID NO: 30088 - DNA, 166 bp, Homo sapiens
ggcctcataatacccaccctgacctgctgtaaaagacctggaacaaacaaaaatgattacacctacagtgagtattttcttatgactgttgccctcaaattttacagggcattttcattgtggcccagacatctggaatcaattaatattccatttatctaagatt

SEQ ID NO: 30089 - DNA, 368 bp, Homo sapiens
  misc_feature 312, 321, 365: n = A,T,C or G
aggaagcaatttcccaatgtacctataagaaatgtgcatcaagccagcctgactaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgatntatagaaanagttggctttaaaatgtttgcaaatgtcttttttttttttaatnctg

SEQ ID NO: 30090 - DNA, 473 bp, Homo sapiens
  misc_feature 413, 437: n = A,T,C or G
catttttcataagacacactatatcactcgaaataaatgccaaacactagtgtggtgacactttgctcccatatcacaatcactaaattcgacttacccctttaaggccaggtaggaatttagcaacccagctcataaagggtaaaattagcttattatttcctgagtggattgcaaacctcactggccagattgggagcacagcagatacttcctttttgtaaaaacttggctgagtgtggtggctcactcctgtaatcccagcactttgagagcccaaggcaagaggatcgtttgaggccagcctaggcaacacagtgagaccctgtctctacaaaaatttttttaaaaaattagcccggcatggtggcacataccttgtggtcccagctactcaggaggctgaggtgggnaaggatttgcttgagccttggganggttgaagctgcagtgagctggggggttgtgcctac

SEQ ID NO: 30091 - DNA, 467 bp, Homo sapiens
  misc_feature 11: n = A,T,C or G
aagctattgtnactgcagtgcttataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatggagtgtatcacagctttcattaggaaaacttttcattacatacttgtttaaactctgtcttccagggt

SEQ ID NO: 30092 - DNA, 429 bp, Homo sapiens
gaataaattttgaataaaaatttgaataaacgtgccatgattattataagtgacaagtgttagcctgcacatcaagtagaaaaaagattattagatcttttaattatctcaaaatgtgggaaatgtgttaaaactgatggtatataaatttccttgaaccagtaattagtctgtttctcttaaattacctattatgtcttcatttctccctaagaaatagttcccatttccatttacctagtagtagaagactttaacaaggttatatcctattaactcatgagagcagagcttgagcattaactataggtcattaccctgatcttattcctattaccactccccttgaatatttagaaaaatcatttaattgcctgtttttaaattttactccaaaaaaggattagcaattttttaatctactcattt

SEQ ID NO: 30093 - DNA, 472 bp, Homo sapiens
  misc_feature 5, 402: n = A,T,C or G
atttnagttgtaacataggaaaatagatatttcctagatgatttctgagtttcttactgcaaagaacagttataaattggtatacatgtgtctctgtaatagggataatattgatatatctgttgctacatatttaagaatcattctatcttatgttgtcttgaggccaagatttaccacgtttgcccagtgtattgaattggtggtagaaggtagttccatgttccatttgtagatctttaagattttatctttgataactttaatagaatgtggctcagttctggtccttcaagcctgtatggttttggattttcagtaggggacagttgatgtggagtcaatctctttggtacacaggaagctttataaaatttcattcacgaatctcttattttgggnaagctgttttgcatatgagaagaacactgttgaaataaggaactaaagctttatatattgatcaaggtga

SEQ ID NO: 30094 - DNA, 194 bp, Homo sapiens
  misc_feature 38, 39, 193, 194: n = A,T,C or G
cagagcgaaagcatttgccaagaatgttttcattaatnnagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttgcnn

SEQ ID NO: 30095 - DNA, 473 bp, Homo sapiens
ctgatgtggaggcaatcttttcgaagtatggcaaaattgtgggctgctctgttcataagggctttgctttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataaggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaagggagatgaccttcaggccattaagaaggagctga

SEQ ID NO: 30096 - DNA, 471 bp, Homo sapiens
  misc_feature 399: n = A,T,C or G
gtactccccatgtgttgaggtagggacctggtaggaggtgattcagtcatgagggcagtttcccccatgctattctcctgatagtagggaagttctcatgagatctggttgtttgataagtgtctgggatttccccttatggcacactctctcctgctaccgtgtaagagggtgcctgtttctcctttgccttctgccatgatcgtaagtttcctgaggcttctccagccatgcagaactgtgagtcaattaaacctcttttgtttataaatgactcagtttcagtcagtgtgaaaactgactaatgcatcatcattccaaaattcctttatcaatattagcaaattaaatttatcaatatacttgaaatcaagattaatggagttttatcctaagagnagaaagactaggttaacattcataaatcaatcatcaccatctatcaatacacataataaagaagaaaacaca

SEQ ID NO: 30097 - DNA, 161 bp, Homo sapiens
ctaaacacgaatgttaatttacatttttaacctaactgaatgagttgtttttcttaaattcctttgcagtttgaaggaacataccttgcaacaggaaagctttaagaaagaggacgaaaaggctttataatctttcttgaagagaccctgttgctaaaaag

SEQ ID NO: 30098 - DNA, 284 bp, Homo sapiens
gcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacattcg

SEQ ID NO: 30099 - DNA, 473 bp, Homo sapiens
  misc_feature 456, 468: n = A,T,C or G
gacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttgggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcagaaagtggnggcttggggggnggctt

SEQ ID NO: 30100 - DNA, 472 bp, Homo sapiens
gcatctgatggtctcaagggtcgtgtgtttgaagtgagtcttgctgatttgcagaatgatgaagttgcatttagaaagttcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgtcctgtgttggttttactaaaaaacgcaacaatcagatacggaagacctcttatgctcagcaccaacaggtccgccaaatccggaagaagatgatggaaatcatgacccgagaggtgcagacaaatgacttgaaagaaatggtcaataaattgattccagacagcattggaaaagacatagaaaaggcttgccaatctatttatcctctccatgatgtcttcgttagaaaag

SEQ ID NO: 30101 - DNA, 459 bp, Homo sapiens
atctactgaaagtattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcaga

SEQ ID NO: 30102 - DNA, 327 bp, Homo sapiens
  misc_feature 18, 23, 29, 93: n = A,T,C or G
tctatccattctgtattnatcgncaaagnagcataatggccaaaaccacaggctctagggtctgagcctgttgggttcaaagaacagctgtgngattttgggtgagttaatgagtgttctcagctgtaaaaaacgcatagttttacagttgataatcataggataggaatgggaattaaatgaaataatgcaggaaacacacttccatgtttagtaaatctctttctgctgcttctttcctgctgggttttttttcctcttgatttctttagcttttgcatcatcagacagtacaccaagtgctgtgcctggagtgtatctgtcttg

SEQ ID NO: 30103 - DNA, 115 bp, Homo sapiens
attataagaccaagacgagtcctccctcccaattggaaatatgaatcatctacagcctctgccctggtcgcataaatttgtctgtgtactcaagcaataaaatgattgtttaact

SEQ ID NO: 30104 - DNA, 442 bp, Homo sapiens
  misc_feature 349, 380: n = A,T,C or G
gatttttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaanaccctgaccggcaagaccatcaccctggaantggagcccagtgacaccatcgaaaatgtgaaggccaagatccaggataaagaaggcatccct

SEQ ID NO: 30105 - DNA, 120 bp, Homo sapiens
  misc_feature 7, 14, 17, 18, 19, 26, 33, 44, 56, 63, 66, 68, 77, 113: n = A,T,C or G
aattatnaaagtanctnnngtatggnggcactnatcctgtagtnccagctactcangaaggtngangngggaagatngcttgagctccatgagtttgaggttgcacgtagagntgatcat

SEQ ID NO: 30106 - DNA, 316 bp, Homo sapiens
caaactgagaggaaaaaaatagtggaattaaaaaaatttttattgctgggtgtggtggctcgcacctgtaatcccagcactttgggaggccgagatgggcggatcacctgaggtcaggagttcgagaccagcctggccaacatggcgaaatgccgtctctactgaagatgcaagaattagctgggtgtggtggtgggcacctgtaaccccagctacttgggaggctgaggcgggagagtttcttgaacccgggaggtggaggttgcagtgagccgagattgcgcctttacactccagcctgggcaacagagtgaga

SEQ ID NO: 30107 - DNA, 430 bp, Homo sapiens
  misc_feature 10: n = A,T,C or G
ataacccagncataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatccc

SEQ ID NO: 30108 - DNA, 462 bp, Homo sapiens
  misc_feature 17: n = A,T,C or G
ggaaacaatttccttgnggcatttagcaacacatagaaaatgggctttgattcttttccaaaacttttagccatagggtcttttatagacagggatagtaaaatgaaaattgagaaatataagatgaaaaggaatgataaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattctacatatagtagtctaggaaaaagttgcaggtaatttaaactgtctagtggtacatagtaactaaatttctattcctatgagaaatgagaattatttatttgccatcaacacattttatacttcgcatctccaaatttattgtggcgagacttgtccattgtg

SEQ ID NO: 30109 - DNA, 462 bp, Homo sapiens
  misc_feature 282: n = A,T,C or G
gcttttcgatccgcctctgcggtggagccgccaccaaaatgcagattttcgtgaaaacctttacggggaagaccatcacccccgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagnaagaagtcttacaccactcccaagaagaataagcacaagagaaagaaggttaagctggctgtcctgaaatattataaggtgggatgagaatggcaaaattagtcgccttcgtcgagagtgcccttctgatgaatgtggtgctggggtgtttatggcaagtcactttgacagacattattg

SEQ ID NO: 30110 - DNA, 381 bp, Homo sapiens
  misc_feature 148, 378: n = A,T,C or G
ggaatctggctggcagctactccgaatcttccccaaaaaaatgctgaagagaatccctcagagcaccctcagcgaattttaccctcgagactctgcaaagcattagctgctgcttctgcattgctccgcgctcttgtgaaatactggntctgttttctttattccttttgcactctcggttcccacctttgtgttggagtttaccatgttaccctgtaattaaaaacaaagaataggtaacatattgtgccagtgttgcaacgttttaaactgctaacagaccttaaaatatccccctacctgggtcctcagtgctatgtttaaagtgctgcagggatggagtggcgttttcttattgctgtatgtattgtacatagngga

SEQ ID NO: 30111 - DNA, 118 bp, Homo sapiens
aagagaggaaatagcaacatttacctcagatggcctctgatagaactctgggcaagaggcctctgggtaaaagaagactcagcagaagagatctaatgatgcagagttgaaagataat

SEQ ID NO: 30112 - DNA, 155 bp, Homo sapiens
aagaataacaagggtggcatattaaggataaggattaggaaagcagaatcggagatttgtaaggaaactggttatttatttgatctcacttctacttgattatctttagtaatgtggaaatagctacttcgggttgtagtctttattatgttaga

SEQ ID NO: 30113 - DNA, 458 bp, Homo sapiens
  misc_feature 31: n = A,T,C or G
gaggcattgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaaaagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagaga

SEQ ID NO: 30114 - DNA, 373 bp, Homo sapiens
  misc_feature 7, 32: n = A,T,C or G
ggaaggnggagttgagagaacggagcggacgncatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccggacttgaaagagggctccagaaaaagtagatgcgtatctgtacaaacagatcctactgatgaaattcccactaaaaagtcaaagaagcataaaaagc

SEQ ID NO: 30115 - DNA, 379 bp, Homo sapiens
gggatttataatatccgttgattctcattatttacagtagttatgttctataaagttgccaggaatactcgattagtaaatgctaaaccattgctcctggggaaatgcagacttaagactcctgtgagcctctggtcacaatgtttttgtcaactgagtaacatacaaccttgtgttactgtttaaagacactttatttcatatattttattgattcattaacattgaattcacactaacagcactatcactcatgcatgaacaagtcttatctaacacacttattttctccagaggtacattatagccttcttgtgcttaggaataccacatggctcttcagcgctatgtttgggagccattttaaacaacaaaatca

SEQ ID NO: 30116 - DNA, 281 bp, Homo sapiens
  misc_feature 6, 11: n = A,T,C or G
attctnatttnctaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacatcc

SEQ ID NO: 30117 - DNA, 196 bp, Homo sapiens
gggctgtcgcctgacagcatacctcaaaagccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaacctca

SEQ ID NO: 30118 - DNA, 491 bp, Homo sapiens
  misc_feature 6, 32: n = A,T,C or G
gcacancaagcagaagaactcgcctctgttgnttgtaagtagccaaacaataaccaaggagaataacagaaatgtccatttggagcactcagagcagaatcctggttcatcagcaggtgacacctcagcagcgcaccaggtggttttaggagaaaacttgatagccacagccctttgtctttctggcagtgggtctcagtctgatttgaaggatgtggccagcacagcaggagaggagggggacacaagccttcgggagagcctccatccagtcactcggtctcttaaggcagggtgccatactaagcagcttgcctccaggaattgctctgaagagaaatccccacaaacctccatcctaaaggaaggtaacagggacacaagcttggatttccgacctgtagtgtctccagcaaatggggttgaaggagtccgagtggatcaggatgatgatcaagatagctcttccctgaagctttctcagaacattg

SEQ ID NO: 30119 - DNA, 315 bp, Homo sapiens
  misc_feature 7: n = A,T,C or G
agcaaangatgcaatcaacaaagtgaagagacagcctacagaatgtaagaaaatacttgcaaactacccttctgaaaagggattaatagccagaatccataagaagttcaaataactctttaggaaaaaaagtctaaaaatccaatcaaaaaatgggcaaaagatttgaatagacgtcactcaaaagaagacatggaaataataaatataaaaatgtgctcaacatcatcaatcatcagctaaagtgcaactcaaaactacaatgagagatgtcttctcacctcagttaaaatggcttgtatcaaaaaatcagac

SEQ ID NO: 30120 - DNA, 478 bp, Homo sapiens
  misc_feature 33: n = A,T,C or G
ggtaggcagcctctctccctactgctgctacanaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagagggtccgagaacgctctaagcctgtccacgagctcaatagggaagcctgtgatgactacagactttgcgaacgctacgccatggcttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaat

SEQ ID NO: 30121 - DNA, 458 bp, Homo sapiens
aatgaacatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcaccc

SEQ ID NO: 30122 - DNA, 467 bp, Homo sapiens
  misc_feature 32: n = A,T,C or G
agagacaatacaactacttaaaaaatatagtntataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatgga

SEQ ID NO: 30123 - DNA, 421 bp, Homo sapiens
  misc_feature 31: n = A,T,C or G
gctctcggccttagcgccatttttttggatncctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 30124 - DNA, 378 bp, Homo sapiens
caatgagtggtatgccagagtaaggccctagagaaagaagaccagagttaggaaaaccttaaattaaaagattaagctatgtggaaaaactattacatgtcagagttagtggtaaataagagtatgttaagttaagatataaaggaagaagagtaatattaaaaaagaacctggttttctatccctgtgtttagtccagcaaactaagtgatgtggatattctcatttacatttattatctgtcctattagaacattgaattttctataagaagcctttaaacttgtataatatggcgctttatgctttgcagagttttgtttgtttttgggatggagtctctcactccagcctgggcgacagagccagactccgact

SEQ ID NO: 30125 - DNA, 207 bp, Homo sapiens
agagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggc

SEQ ID NO: 30126 - DNA, 488 bp, Homo sapiens
aaatccttaggtagccttttctgaaattcttaaacccgccaggaagggtcagagataaacccttgatatctagcaaaaacaaataaaaataagattttcaacagatcagtggatttcataaaagatagaacgtataatatgaaagaaacactgagggtacatgatcatctgtgaagcataatgtaatgagaacaatactggacttgaactaaaagttttgtgttcacagcccagatttactcccaactatgtgatgttgagcaaattactgaatgtcgcttaagcctacgtttttgcatttatataaggataatagtaccacctaccttacaatattactgaaaaaggttcaactgggcaaggctaattaaataataataaagtataccatattcttagtttccttttttaaaaaatctttcctgaattttggttagagtaagtcctgattcaaaggacagatgtgtgtgtcttccttccttgaaact

SEQ ID NO: 30127 - DNA, 196 bp, Homo sapiens
  misc_feature 32: n = A,T,C or G
gaatcttagttcaactttaaatttgcccacantaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccg

SEQ ID NO: 30128 - DNA, 402 bp, Homo sapiens
  misc_feature 2, 3, 32, 80, 102, 116, 126: n = A,T,C or G
gnnggcgatagttaagaacagcctcatgcttnagaaacacatacattctcaggcgctcggggtgagtgaaggagaggggngaatagttctgtcggaactttncaggccatgtgagnctatgagctnttttgtagtttgacaatttggagaaggctttactgctattactgggagtgactccttggctaagatcccagcaagttaggatattgctttgctattcttacatgtgaccatcttggtaaaatattttcaatttctatagcagcaacccatgagcagtagtgggatttgggaggactccacagtcttgattcctctgcttgggacatttgtccttttcaggtttctgttgtttctctcctcacttcttttattttaaaatttatttatttacttttt

SEQ ID NO: 30129 - DNA, 465 bp, Homo sapiens
  misc_feature 30: n = A,T,C or G
ggaaaatggcggacgacgtagaccagcaanaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaagcaaagaatttgtcctgtatggaaaacgggagactttgtacagtggcctctctaaaagtacaaaacattcataagagaaacctgcatacattttgatattaagaaataattccgggggattcttccactcctgaaatgagttgatttgca

SEQ ID NO: 30130 - DNA, 199 bp, Homo sapiens
  misc_feature 10: n = A,T,C or G
attctaaatncattttggcctaattagatatcccaacaatgaattcagatgtttcatgactgggctagaaagagcatgatgatgaagtgggagctgatagaaagctccccttcctcccagtattctagatgaaaaataacatagtctgtgttaaaaatctgttacaacttcaatagttctatttcttctgagaaatgca

SEQ ID NO: 30131 - DNA, 355 bp, Homo sapiens
  misc_feature 1, 64, 83: n = A,T,C or G
naaccgacaaatactaccaagtttgatgaaaatggtctgcccacacatgacatggagggcaaanaagctcaagcaaagggcangccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagcga

SEQ ID NO: 30132 - DNA, 433 bp, Homo sapiens
  misc_feature 6: n = A,T,C or G
cacttncttacagttggaaaactaataaatgcagaaggaataacaaatttaaaatatcaccatttggcaactatcacaattaaaattgattcagaaagaatcatcaattctattctaaagttagttggcaaaagcttcatgaggaaatatcttccaaaaattacttattaattacaaagagaaaaacagtaattatacagtggagatacctggcagacaccaacttaatgatcaaggttaatcccacaaggattgggacaaacagacatgatatgtatcatgatttgattaactgaaaagaaacagcatgacttctgtgatattcctgccaaaaatgcatgcccaaaatgcaaaaatgcatctaatcaaggtattcaaggaaatgaggaaaaaattcacatacttaaatctaatcacaaggaaacatcaggac

SEQ ID NO: 30133 - DNA, 373 bp, Homo sapiens
  misc_feature 29, 31: n = A,T,C or G
gggaccaagaaggaggagctgctgaaacntntggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgtattgtcaataaagcacagctggcc

SEQ ID NO: 30134 - DNA, 486 bp, Homo sapiens
  misc_feature 6: n = A,T,C or G
attgtngcggtatatctgtaatatggctccttttcttccttaacatttctgcaacttgccacttcttcattgaagtccatctgaattcaggctcttcagagggaaagtgcccttttcctagttctgtccccctcactccctttttgttcaacgtgtccattatgcttctcaaaggcacagtggaaatgtgcaattcaagctggtgatgcctcagctcataaccaacaggcctttcaaaaatgaccttggaaaatttacactttaaaaagtatggctaagtgagtcacatcttagaaaaacatctgctttttggatttcttccaaagaataattgtatttatttgatactaacacacattgtctgcctaatttgctcaactttgtccctattttacagatgagaaaattgaggagaaatagctgatgactccaataggtggcttttatagctcccttccaagacccataaagcaaaaattctcttac

SEQ ID NO: 30135 - DNA, 318 bp, Homo sapiens
  misc_feature 6, 316: n = A,T,C or G
gagacntaaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctntg

SEQ ID NO: 30136 - DNA, 488 bp, Homo sapiens
  misc_feature 28: n = A,T,C or G
ctgcaggcagagctgtatttctcttggntttttatttccgtgcctgaaggtgcctgagatattggtgttcatttgctgttttcctgctgacaaataattacatagaaacaaaatcctggtgtctttagataatttacctaggtctttggtaagcattttggcttccagatagaaattctctcatcctcagcatcaggctcattattattatttgaaaatttgaaaacactggcaaagaggcaagttgcagtgcagtaataaggtccttaattttctaccatctgctggaagttcattctgctgcaagctgaccatctgatgcatttttggtttgttgggctgacagttttactgcttagaaatcagaagaaacaacacactggactcataaggagggaatgctcattgaacggggaattgatgggaatttgggaaaaaaggtggctgtcatcttggcgagtatgccagggagtgaaataaatcttttg

SEQ ID NO: 30137 - DNA, 296 bp, Homo sapiens
  misc_feature 5, 31, 275: n = A,T,C or G
ggatncagtgagcctgctttcgcctgctgtntctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaaagttaaaaacctaaaaaaatggagnaagcatatttcaagaattatt

SEQ ID NO: 30138 - DNA, 406 bp, Homo sapiens
  misc_feature 7, 13: n = A,T,C or G
tactaancgcagnacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattgggagaagtttagaagatagaaaaatataaatccaaaaattggataaaatagcactg

SEQ ID NO: 30139 - DNA, 467 bp, Homo sapiens
  misc_feature 28: n = A,T,C or G
ctctgtcactaggtattgccaatgaaantggagggataacattcttccctgtccaagtcaatgttggggggcaggcacaagctgtgacaggctccatccagcccctcagtgctcaggccctggctggaagtctgagccctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaactgaggaaaaaatctggacctgctttgaattctccataattcagtgtcctgaacttatgatggacagacatctggaccagttattaaatgtgtgccatttatggtgatggc

SEQ ID NO: 30140 - DNA, 165 bp, Homo sapiens
gcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgactcc

SEQ ID NO: 30141 - DNA, 487 bp, Homo sapiens
  misc_feature 3, 21, 23, 24, 25, 26, 28, 31, 50, 53, 56, 58, 59, 61, 62,63, 64, 65, 66, 69, 71, 73, 77, 83, 84, 86, 92, 94, 100,125, 184: n = A,T,C or G
ganggacaacacctgactganannnngngcnatgttcgctttggtctatnaantantnngnnnnnnatncnangagntttgtnntnatgctntncagttnggggtgtctacttctctgtggaagnattacactagccctgggaaatgcacagaaattgccaaaaaggtaaaaaggccaaacctnaaagtccacatcaataccacaagtgactccatcctcttgaagttcttgcgtccaagtccaaatgtaaagcttgaaggtcttctcctgggatatggcagcaaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtc

SEQ ID NO: 30142 - DNA, 395 bp, Homo sapiens
  misc_feature 32, 105: n = A,T,C or G
ctgttggagatacaattaagtagttacaatcnagatataatcaagtagttacttttgtgcttttgatttagtgctttttattagatattattaatctctaattgntttattgtaataatttaaaatacagttgtaaaaatttgattgaagaggactgaaagtttacagaaccggggaaaaggtttcccctgtgttacttgggagtgttgaatagcttgaattgggactgaatgggcatattttgagtgaattatgtttgttggatgagtaagataactgggaaagtggtctgggaccattcattgagcagacatttatctattaataataccttccaggtcccaggcattaattaggttctgaaagatagggtgggaataatagtaatgtaaaga

SEQ ID NO: 30143 - DNA, 408 bp, Homo sapiens
  misc_feature 7, 33: n = A,T,C or G
ggatgcntctgaaaattctatttaatacaatantgctgctttttcttaaaaagtttttagattgatgatgtcttagcgtcaagtgtcttaggactcagaaaatggtgtgtgggctacattatctacattggcctaatttttgacaagactgcatgaaaacttttgacagcaattggtgctggtccttgaactagatgacctttacactgttttctgacagtgatttgtggattgtttataaacatgaattttctacatgttagctctgttactacagtacttttgacagcaattggtgctggtccttgaactagatgacctttatactgttttctgacagtgatttgtggattgtttataacatgaattttctacatgttagctctgttactatagtactgatttatg

SEQ ID NO: 30144 - DNA, 349 bp, Homo sapiens
  misc_feature 6, 31: n = A,T,C or G
cactantcgatggttctgatgctctgcatgnaccacagtcaccactccctctgcttggatgttcatctttcccacttaggatcaagttagaacttcctattctgagtctccaggtttttcaaggaaaggaagatagaggatgagcagcaaggcggttttcctaatggttagtgtgagttgtaaaggtggtcccagctcacgtctcctgtctttctgtgctcacctgcctttctgatgttctatcttcccacatccattgctcaaacacatgcagctttttctttttatttatactttattactcaaataagaaatgttcattgtaaaacagctagacaatgaaataagc

SEQ ID NO: 30145 - DNA, 461 bp, Homo sapiens
  misc_feature 31: n = A,T,C or G
gaggcattgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatcttttaaaaagagatt

SEQ ID NO: 30146 - DNA, 466 bp, Homo sapiens
  misc_feature 7, 430: n = A,T,C or G
attgacnatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattngttttactcctttttattcatacgtaaaattttgga

SEQ ID NO: 30147 - DNA, 471 bp, Homo sapiens
  misc_feature 417, 434, 470: n = A,T,C or G
gaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattaccctcgtcacttgcaacttgntattcgtggagatgaanaatttggattctctcatcaaggctacaattgctggng

SEQ ID NO: 30148 - DNA, 490 bp, Homo sapiens
  misc_feature 7, 32: n = A,T,C or G
actcccnaaaaaaagaacctttggatacatangtatggtctgagctatgatatcaactggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaact

SEQ ID NO: 30149 - DNA, 457 bp, Homo sapiens
gaggccttgaggcagccagcgcaggggcttttgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatcttttaaaaaga

SEQ ID NO: 30150 - DNA, 470 bp, Homo sapiens
  misc_feature 467: n = A,T,C or G
gattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggggctgcttgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcanaca

SEQ ID NO: 30151 - DNA, 160 bp, Homo sapiens
  misc_feature 3, 8, 9, 11, 15, 23, 32, 41, 89, 125, 145: n = A,T,C or G
gtnaacanntntggngatatatnctggatctntcacctgtnatcataactggctgctgcttgtcatccacacaacaccaggcacttaanacagcatgggactgatgtcgtcttgagctcttcatntattctgactgtgactaatnctggagtggaggcat

SEQ ID NO: 30152 - DNA, 198 bp, Homo sapiens
  misc_feature 8: n = A,T,C or G
agcattcntggagctttattatctttctggtttgtaaaatcttgaatggttgctcttctaggaattcagtatttttatggaattgtacaaaatagcttacccctactaaggttggaaaagaaaatggtagcattatcatgttctttctatcttattcatattattaaacctatttttaatcacatataaatttttacg

SEQ ID NO: 30153 - DNA, 384 bp, Homo sapiens
  misc_feature 7, 32: n = A,T,C or G
ggccccnccacatatataaatgtatggattgntatccacttggaggataggactatggtagaatgtcaaggggtactatctgtatctttattctgctcaacatttattgctatgaaaatattgaagcatattttcacatttgtatatgacataaggtcatattttaaagtattttaaaacgctggaatagtggggctgaattcaaagtgaaattcaaaagggataaatactatgatcttacagtaaaaacttctgcatcaggagaggatttggaggagccaaactcagccatacaacatgtatttaatattttttaacagtgagttttcaaagaaaattttaaaaactaatgcaatttaattgtgtgtaattgaaatttagttt

SEQ ID NO: 30154 - DNA, 463 bp, Homo sapiens
  misc_feature 6, 16: n = A,T,C or G
gcaatnaagtgaaagnaagcttatccgagtttcattaaatgactttattttaacaacagagacgttaaagacctaataatacacaagctttgtgtgtcacattctgaaagggcaaattaaaagttcatttaccttcaatattgttatacacatatatttaaatatttatgttgctcttcctacctgacttcatttgaatgatttgagagaaccatttcatatgttttgttttttcagtgaatcttggggcttactctctgatattctctgttagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggtaaaagaac

SEQ ID NO: 30155 - DNA, 397 bp, Homo sapiens
  misc_feature 32: n = A,T,C or G
aacaaccctgaatttgtattatccagtataanactttaagtaggagatttttaatacattgttgttggtaactgatagaacaagatgagaccaaaatttaaaaaaaaatacctatataagacagcatacttaataaaattaaacctttgatgaggcggaccatgaagaaagagaagacctcattaaccaatgttgaggtgaagaggatatcacaaaggcttatgagaagatattataaaaacttgatgtcagtccatttgaaatttagatgaagttatactattagaaaactacaacttaacagacacagcagaaaatagaaaatctgaatagtcctattaaacatgatccttattggaaagagctacccactagttttgaagtctttgggatttac

SEQ ID NO: 30156 - DNA, 469 bp, Homo sapiens
  misc_feature 7, 32: n = A,T,C or G
gaagcangtccttgatgtgcagctggcattcnttcgacttctctccagccgagcttcccagaacatcacatatcactgcaaaaatagcattgcatacatggatcaggccagtggaaatgtaaagaaggccctgaagctggtggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttat

SEQ ID NO: 30157 - DNA, 258 bp, Homo sapiens
  misc_feature 31, 33: n = A,T,C or G
aagcctctggcatgttggaacaaggaagggntnggaaggaaggaggaaggaaggaaggaaggaaaagaaagacatatagatcagtgggatagaattgagagtccagaaataagtcctcacatttagggtcaattgattttcaacaagtgtgctaagataattcaacgagaaaaaaatagtcttttcaagaaatggtgctgagacaactggagatccacatgcagaagaatgaagttggactcatacctaacactatat

SEQ ID NO: 30158 - DNA, 415 bp, Homo sapiens
  misc_feature 32: n = A,T,C or G
gaatcttagttcaactttaaatttgcccacantaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcac

SEQ ID NO: 30159 - DNA, 323 bp, Homo sapiens
  misc_feature 32: n = A,T,C or G
gacgcctttcatctgtcccgctgcgtgttttnctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttt

SEQ ID NO: 30160 - DNA, 355 bp, Homo sapiens
ggttgagagaacggagcggacgccatggcgaccaacatcgagcagatttttaggtctttcgtggtcagtaaattccgggaaattcaacaggagctttccagtggaaggaatgaaggccagctgaaaggtgaaacaaatacacccattgaaggaaaccaggcgggtgatgcagcttgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaag

SEQ ID NO: 30161 - DNA, 109 bp, Homo sapiens
  misc_feature 31: n = A,T,C or G
ctaaggcaggagaatcacttgaacctgggangcagaggttgcagttgcagtgagccaagatcgtgccattgcactccagcctgagcaacaagagtgaaactccgtctcg

SEQ ID NO: 30162 - DNA, 204 bp, Homo sapiens
  misc_feature 144: n = A,T,C or G
caagaccagcctgaccaacatggagaaatcccgtctctactgaaaatacagaattagctgggcatggtggcacatgcctgtattcccagctactcaagaggctgaggcaggagaatcgcttgaatctgggaggcagaggttgcnggtgagccaagatcacaccattgcactccagcctgggcaacaagattgaaactttgtcct

SEQ ID NO: 30163 - DNA, 271 bp, Homo sapiens
  misc_feature 17, 23, 33, 45, 46: n = A,T,C or G
tatggcccggggtattnaaaagnaaaattgagnagaaaggacttnngagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacga

SEQ ID NO: 30164 - DNA, 463 bp, Homo sapiens
  misc_feature 5: n = A,T,C or G
atttncaatatgtctttcgtcaaagccttggtaataaccatgcttttaaattgtattctgctataaagaagacagatttttattgggcttatgcaaataatcatattaccataagaatactaacaaatactttctgaattctggaggaatcaaggaggaaaatccaaatgattttcctttttttcttttttcttttacaaaagtatatcttaccaaattgctataaatgatagctcaagagagaaaatgttcctaaatctgaaaaacaaaacattaagaaccacatgtatcaagtaaaaaatcataaaaacattgtcttcattagttattcagtctcatataatcaacatttgttctctttgatctccactagtagttttctgaatccatcagtttattagagttctgggaagttttcatttagtccattgatattaaagttatcagaaacctgtatttaaga

SEQ ID NO: 30165 - DNA, 490 bp, Homo sapiens
  misc_feature 3: n = A,T,C or G
canaaacattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgc

SEQ ID NO: 30166 - DNA, 297 bp, Homo sapiens
  misc_feature 31: n = A,T,C or G
ggagccgcaagggctttgggaaggggatgantatctctttttacctttaacagacttgtttaatcttctcgatgtagatgtttatgtaggtacttcacattgcaaacgccttttattctatttacaagctcagatgtctctgctctcctgaatcttgggcatgcctttctgtaaccaaaaatccctgtaggcgtgctagcaattccagggtggtccgggtttggcagatttgatttttaaaaaacgtattatctttaataaaatgttattatgtcaaccagtgaggctgccctgagc

SEQ ID NO: 30167 - DNA, 449 bp, Homo sapiens
ggtccctctcttaccgcctcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtattttt

SEQ ID NO: 30168 - DNA, 418 bp, Homo sapiens
  misc_feature 6: n = A,T,C or G
ggattngaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctat

SEQ ID NO: 30169 - DNA, 465 bp, Homo sapiens
  misc_feature 6: n = A,T,C or G
ggggcnttcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgcttttt

SEQ ID NO: 30170 - DNA, 408 bp, Homo sapiens
aatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccct

SEQ ID NO: 30171 - DNA, 239 bp, Homo sapiens
  misc_feature 4: n = A,T,C or G
gacnacagtgagagctgccttatattcctacattccaggccagaaccagcacaggactgaacgcatccctggttgtaatgtccatttccatcttccccgtctccctttccacatcaaggcacatcagacttctcagagacccactttattcagttctgtacatatggggacatcggtccaagcccaacccaccttagcatgtatcactctgtggagaataaagcaccctatgtacacat

SEQ ID NO: 30172 - DNA, 397 bp, Homo sapiens
aatttctaaagtgctgaaagagtaaccctcacaatggattttacaccaaaaattttctttaaaatgtaggcaaaactaatttatagtaaaaaaaaacaaaattagtacagtggttgcctgaagctgttagatgatgcagggatggactgcaaagaggaaccaggagctattggggtaatggcagtgttctgtattttgattgtgttgggggtttgtcagaagttattaaattatacgccttgcatttactcttcagaaatcatacatcaataaagttgatttaaaaactgaaggcaaatttctgcttcttgctaagattaagtaagagggactgcatttaactttccacctgaaacaacttaaaaactagacaaaacaatgaaacaatggtttttat

SEQ ID NO: 30173 - DNA, 343 bp, Homo sapiens
  misc_feature 1: n = A,T,C or G
ngcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttcc

SEQ ID NO: 30174 - DNA, 440 bp, Homo sapiens
  misc_feature 15: n = A,T,C or G
cagtgaaatgacagnataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaaccctttaaataaattgttttgagtgttttttg

SEQ ID NO: 30175 - DNA, 490 bp, Homo sapiens
  misc_feature 7, 11: n = A,T,C or G
gaggacncagnagccctgtgtgcaaggccaaattaattacctaacagaaaacatctgaagatatgagtggccttccaagcaagtgggaaaataaacaactcagcaaagactctctgaaatccagtagaaacctgctgaatttaactgttgaactcagatcaagctatctagtatttattgattacttgaaaactatgagattataacgccagcaatgatctgttgcactaaaatgtatttatagtatctacagaatataagacattttgtccattctgtcatatcgccatagaaagcagaacttagtcaaaagagatttgtactggagatattccagtttctgttgaggatactgatggtttgcaaataatagtgtcaaagtgctcctcaaagagatgtgggaaaatatgtcttagaagtaataatttccaaatttctaaggctgtgacattctgacccagcttggtaactttaactgcatctcagctgt

SEQ ID NO: 30176 - DNA, 415 bp, Homo sapiens
  misc_feature 6: n = A,T,C or G
caccancagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaag

SEQ ID NO: 30177 - DNA, 364 bp, Homo sapiens
  misc_feature 19: n = A,T,C or G
ggttagcaaggatttgatnaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaat

SEQ ID NO: 30178 - DNA, 434 bp, Homo sapiens
tggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggggctccaaggacaagaaacacgtctggctaggagaaactatcaatgctggcagccagtttgaatataatgtag

SEQ ID NO: 30179 - DNA, 464 bp, Homo sapiens
aaccactaaggttacagagatcaggaaaggtcagtaatctgaacaatgtaacctgtgagggaaataattctgacgtcctttacaaagcttgtggaaagaagaagtatggctagagaacatgaactctgcctgagccaaaatgggttcttgtatactccactgctactcaagaaaataccgacaggcgtggttccaaagatcattaaatggccaagaattaagataatctcttgtgacttccggatcacttaagtaacagaacagtaatccttggaagatgaagagggctatttggctgggcgcggtggcttaagcctgtggtccctgcactttgggaggccaaggcgggcggatcacctggggtcgggagtttgagaccagcctggccaacatggcgaaaccccatctctactaaaaatacaaaaattggccggacatggtggtgtgcgcctgtagtcccagct

SEQ ID NO: 30180 - DNA, 163 bp, Homo sapiens
agcactctgtataatcgactggaaatggggatgagggtgtaaattgtattgaaaaagatcgcgaataaaaatcgacaaatgtgaaagcccagaaaaatatattcgtatttctggttttgctggatttttacatttttatataataaaaatgttattttgaaat

SEQ ID NO: 30181 - DNA, 134 bp, Homo sapiens
ggggagcaaccgccgcagttgccggtacatcggggatttctggctctttcctcttcgccttaaattcgggtgtcttttatgaataatcaaaagcagcaaaagccaacgctatcaggccagcgttttaaaactag

SEQ ID NO: 30182 - DNA, 472 bp, Homo sapiens
aggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattat

SEQ ID NO: 30183 - DNA, 154 bp, Homo sapiens
atatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttgcc

SEQ ID NO: 30184 - DNA, 154 bp, Homo sapiens
gaaagcattaccgggttcgctaggctcacagtttcagaatggcttcggttattgcctttccttggtgtactcgcacttcttggctaccttgcagttcgtccattcctcccgaagaagaaacaacagaaggatagcttgattaatcttaaaatac

SEQ ID NO: 30185 - DNA, 463 bp, Homo sapiens
gacaaccttagccaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtag

SEQ ID NO: 30186 - DNA, 323 bp, Homo sapiens
  misc_feature 5, 7: n = A,T,C or G
gaccncncttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttt

SEQ ID NO: 30187 - DNA, 370 bp, Homo sapiens
atagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatga

SEQ ID NO: 30188 - DNA, 219 bp, Homo sapiens
ctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaac

SEQ ID NO: 30189 - DNA, 488 bp, Homo sapiens
gctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgaatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagt

SEQ ID NO: 30190 - DNA, 397 bp, Homo sapiens
  misc_feature 3, 6: n = A,T,C or G
atnagngatcatcgcaaggcaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtg

SEQ ID NO: 30191 - DNA, 487 bp, Homo sapiens
ggtcgcgtctcggaaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacctccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtgaaga

SEQ ID NO: 30192 - DNA, 483 bp, Homo sapiens
  misc_feature 7: n = A,T,C or G
agaattnctgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccattagaattcaatattcacctgccagactggcttatcaagacaaaggtgtccttcataatgaagttaaagtgagtatactgtggaga

SEQ ID NO: 30193 - DNA, 425 bp, Homo sapiens
  misc_feature 21: n = A,T,C or G
ctgcacagctttcaacacagnaccttcatgttctgtattatatccatatttttatggtagaaagagggctgaaggagcttaagttaggagtcctagattctagtgctagctttgaaattgatgttggaaccagggatatttgttttaaaaccagacatattaatgttgaaaaaaagtttcaaaattgttttatagccactgatgaggcctcagtgcctcatttgtgaagtgagggagacaaggctcaaatgacttctgaggcccctttagctacgagattctgtgatcctaactttggttttgctttttgaaatattaacattttctcctaaagtactttggtcatcacttgacccatccttactttgttggaacgaaggaattttactgcagttgtagaaattaacagcaatagcaacacaaga

SEQ ID NO: 30194 - DNA, 473 bp, Homo sapiens
  misc_feature 6: n = A,T,C or G
ggctcncgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggagctctctatgagtgttttggcagtgatggtaaactggttttacattactgcaagtctcaggcgtggggatgaaccacaaagaaaatcaacttgctact

SEQ ID NO: 30195 - DNA, 470 bp, Homo sapiens
  misc_feature 7, 10: n = A,T,C or G
gttactnagnatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggaga

SEQ ID NO: 30196 - DNA, 452 bp, Homo sapiens
  misc_feature 23, 25, 178: n = A,T,C or G
cacccagtgtggagcagcccatntnagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtnccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgt

SEQ ID NO: 30197 - DNA, 107 bp, Homo sapiens
  misc_feature 25, 74, 86, 88: n = A,T,C or G
aaaggaactctgatctttggatgtngggtggtataaagggtgagagtgtgtgtgtgtgtgtgtgtgtgtgcacntgcatacacagntngtgtgttaaaatgtctctg

SEQ ID NO: 30198 - DNA, 487 bp, Homo sapiens
ctctttggctctctgaccgcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctctta

SEQ ID NO: 30199 - DNA, 460 bp, Homo sapiens
caaacaagcccaaccaaaatactgtttaaggttattaaggatgcttccttgtagaaacgggattgaatatgatgtgatcctgtgagatctgatcatctcaatgggtcttaaggttgaaatgaacatcttccttttaggcagagaagatggcttgaatttatattaacacatatgctgtgtattgtcagagggtaatgagaattaaaatagcttatcaatttcttcactttggtttggtgaggaagtggaatcataaggttagtattgatcagatcatataagataaaaatgtgctatgtaataacctgttacattatggacactaggaattatttttaccacatgtgacatttttacctttatatccttttctctaccagtgaggaggttgaggaaatgttttaaaataaatttaaaaagaaagtttgtatgcaaatatcttgtttaattattttcatga

SEQ ID NO: 30200 - DNA, 487 bp, Homo sapiens
  misc_feature 6: n = A,T,C or G
cactgncctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaat

SEQ ID NO: 30201 - DNA, 489 bp, Homo sapiens
  misc_feature 5: n = A,T,C or G
ggggncctggatgttgatgtcctgcatctaacgcggtgtaacccccgagccgagcgagctccggaggaatttcagtatctgctacggtaacttcatcagcccgccaagatggcgatgcaagcggccaagagggcgaacattcgacttccacctgaagtaaatcggatatcgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatg

SEQ ID NO: 30202 - DNA, 248 bp, Homo sapiens
  misc_feature 8, 26, 27, 28, 32, 33, 45: n = A,T,C or G
gcggctcnctgctcgagctcacttgnnnaatnnggcctatagagnggtatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaaca

SEQ ID NO: 30203 - DNA, 490 bp, Homo sapiens
  misc_feature 7: n = A,T,C or G
gtttatnttcttatcctaccggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctaga

SEQ ID NO: 30204 - DNA, 488 bp, Homo sapiens
  misc_feature 20: n = A,T,C or G
aacatgccagactggcgagnacttgcgtctaccccaatccagcaaacgttcccaagaagaactggtggagcagcaagagcaaggagaagaaacacacctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattc

SEQ ID NO: 30205 - DNA, 489 bp, Homo sapiens
atttctgaataaaatttacatgcatttctcagaaaaaaaatatttggaattgaggtatctaatagagaactgagttaaattattgccacttaaaaacacaaagtgatatagccactttgtgaattaatcagtcagcagtggctaggttatgcttagtggtttataaccaaatcttagtttataacaacaaatgtgtattgttaattcccactacaagtttataacgacattgctggatgctacactccatgtctctttgtgggacccaggctcatgggacttctgttatctgcattagagagagagaagacaacaaaatatgcacaggttcttgaagctttggcccagaagtaaaatatgtcttttacctgttcacattgcattgggccagggcaattatcatggctgcaagtaacttcaaaaggatgggggaagtgcgatcttggcatgtgtcagaagaaatgaaaacatttggtgaagagcattaat

SEQ ID NO: 30206 - DNA, 190 bp, Homo sapiens
ctcaggcaaggggataagtggagggccagggagaataaataaaactaactttaagctgataacttactaaacctgggagatgggtctagggctcactacacaattctccccacttctgtgtatggttaaaatttatataataaaaaagtttaaaaagaaagttacattaaaagcagaagtgttacaccag

SEQ ID NO: 30207 - DNA, 199 bp, Homo sapiens
  misc_feature 24: n = A,T,C or G
agtctcaggaagggtcagaacagnacaatacaggtcaaagcagcaaggctaagggtgacaggtacacaacgctgcagcccccagatctagagacaagattaggatttcggtcagagggggatgaagcacacaccatccccactcccacccagcaccaccatcctaccccttcccgatctaacaaatggcctttggttac

SEQ ID NO: 30208 - DNA, 163 bp, Homo sapiens
  misc_feature 6, 25: n = A,T,C or G
ggtaanaatctttaaaacaaacagnatcaggttatcactgttacactcatgccgattcgtcaaaatatccattctaaattgttgcctcttagaaagtttttctataagaaggcatttgttaaaaaaagagagagggaaagaaaaaaagaagacccaccctaac

SEQ ID NO: 30209 - DNA, 252 bp, Homo sapiens
  misc_feature 6, 7: n = A,T,C or G
atgggnnagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagta

SEQ ID NO: 30210 - DNA, 228 bp, Homo sapiens
  misc_feature 16: n = A,T,C or G
atatccctcttatttnagtgagaaacataggtaaataacaaagctttcattttgtaggcctgggaattatacagttgggttcattctgaaatgcctgataaattgcacaaggactatccatttcatttacacactaaaatatcttaaaagagatataattttttttcctgctgtgtctttacacttgaaaatttctttgtaaaagtggaataaagaaagactatttag

SEQ ID NO: 30211 - DNA, 488 bp, Homo sapiens
atcatcgacatggggtacatcctacagttgataacacatcctcatctttcttggcaataagtaaaatagttgtgtattttacaaaatagatggcctcctagcttctgtgaaatgtgtgatagccacttaccagaacatttccatcctgccgcaggaacttcatgtcgaatgctttgtcttatttattttgtaattttaaatttggagccagagttccgtattcctgtttaatttgttttttacttttaaagcagtttatgatagaactccttgaggttaaaaaatagtatttgtagtttttaactctaaataattgctttttgtttgtttttgcttgttcgtttgtttttgagacggggtctctctctgtcactcaggctggagtgcagtggcacagtcacagctcattgtagcctcaaactcccgggctcaagcgatcttccctccttatcctcctgagtgacttggactataggcatgccaccaca

SEQ ID NO: 30212 - DNA, 490 bp, Homo sapiens
attggccagagaagtttctgtggatgttcctcatctgaaattttgagaatggagagaattattctggataggttgaattgggatctttacacagccacaccattggattttcttcatattttccatgccattgcagtgtcaactaggcctcagttacttttcagtttgcccaaattgagcccatctcaacatttggcagtccttaccaagcaactacttcactgtatggcctgcaaccaacttctgcaattcagaggatccatgcttgctctggccatggttagtctggaaatggagaaactcattcctgattggctttctcttacaattgaactgcttcagaaagcacagatggatagctcccagttgatccattgtcgggagcttgtggcacatcacctttctactctgcagtcttccctgcctctgaattccgtttatgtctaccgtcccctcaagcacaccctggtgacctgtgacaaaggagtgt

SEQ ID NO: 30213 - DNA, 149 bp, Homo sapiens
  misc_feature 6: n = A,T,C or G
ggtgancaggcgggtaactgcaggctcattagcgagtaagagtaggatcagtggcaggatttagcaaatggtgtagttcaaggatgaatagaatttgagaatatcaaactcaaaaaaatgaggttaatgagaggaagagcaaagttggt

SEQ ID NO: 30214 - DNA, 490 bp, Homo sapiens
  misc_feature 6: n = A,T,C or G
ggcgcnctagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaactctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcct

SEQ ID NO: 30215 - DNA, 500 bp, Homo sapiens
  misc_feature 7, 16, 233: n = A,T,C or G
aatgagnatgaaaagnatgaaatgatgagatgaaatgaaatgatgagatgaaatgaggtgaaatgaaattagatgaaatgtaatgagatgaaatgaaatgacctaatgaaatgaaataatgaaatgagatgaaataaaataatgaaatgatgaaataatgaaatgaaaatgagatggaaatgatgagatgagaagaaatgatgagatgaaatgatgaaatgatgagatgaganaaaatgagatgaaatgatgagatgagatgaaatatgatgagttgaaatgacataatgaatgaaatgatgaaatggaataatgaaatggaaatgatgagctgagatgcaatgagttgaaatgagatgaaatgatgaaatgatgagatgaaatgatgaaatgaaataatgaaatgagatgaaataaaataatgaaatgatgaaataatgaaatgaaaatgaaatggaaatgatgagatgagaagaaatgatgagatgaaatgatgaaat

SEQ ID NO: 30216 - DNA, 490 bp, Homo sapiens
  misc_feature 29: n = A,T,C or G
aacaggccctttagtaagctactttaatnagtttttctccttgaattaatcttttctcttaatttttattatgtactagttgtattaaagctaatgtgtttactttttcctcttgtggatttgtagctgtttaaaatttcaggtgaatttcagtagctattgaattaatttagacttcactttgtttttaagaaaagtacaattttttctttttggtaaaacaaaagtaatcagggaaagatgttttcagtagaatacaaattagtggcattcttgggtttctgaggacaatgaaactaaaagaaattttgaaattatacaaatttatgaaattattaatattttagcatagtgctaatcactaatcattgagctttattattctgttgtctatgtagtgagcaaaatgttgagaattttataattccaaatttttaaaataattcaagtgcataaatttactggaacatacttctcaacttttgaatta

SEQ ID NO: 30217 - DNA, 228 bp, Homo sapiens
  misc_feature 5, 226: n = A,T,C or G
caganatatggtaaacctaaatattttataaattaaatgttttatattttatcatatcatttagttacatcaacagttctttgggagagttattttttctgttttgggaaatagaagtttgagggatcaagtaatttgcatagaataatataaattacatagggcaatatgagaagggtaagttgactgagtttactctagggtgaaaaataggccactggtaatncg

SEQ ID NO: 30218 - DNA, 490 bp, Homo sapiens
  misc_feature 186: n = A,T,C or G
actgccccctctgcttcccaggctcaagggatcctcctacctcagactcccaagtagctgggaccacaggtgcacgccagcatgcccgactgattttttgtatttttggtagagacggggtttcgccaggttgccgaggctgatgcccatgattttctatgtgatactatcttctccgtcatcaanaacattttttaagattactcttattatgtctctgggattaatctccaagctgctgattacatcgtgcacgtttgatactgtcactttcatgatgttaaccaatatcacgaaaatgaaaatttcatcaggaaaagcaactcagtcccaagagtttttcagtgagctcattctttaacaaatcgctcctgtgcaggcattgacagctgtgtcatgacagctgcctgaccatagtaaggtgtcatcaattataaaatgcattccagttttcagagatgttttgaaagagatgatggaagattcagag

SEQ ID NO: 30219 - DNA, 490 bp, Homo sapiens
cttttcagataaaaggtagtctgccccaggtaatggagagaattagggggctccattatggtgacatgtgtggtaccatggtcatcttcttttatggagatggggctgtcatggggccagtcctggcaccacatcgcaaagtccaggacaaagctaacatgtttgtgctggcttgacgtgctgttgactacccagcacgcggtcctactctgaggttccactgaggtcggcttccctacaaactccctgtttggtggatcgtcgtcctctggcatttgctcacagaatgctagacttctgacttgtcaccatgttggggcaccaacatttctcttttctgcactgatttctccaaactttgaaaaaacagaccaggctatgttagcacaggagcaggtacccacaggttccattcagtgcttagccactgattacctgctgtgtggcccatcctctactgagcgttttggaaagttctctagaggtatag

SEQ ID NO: 30220 - DNA, 490 bp, Homo sapiens
cttttttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtca

SEQ ID NO: 30221 - DNA, 100 bp, Homo sapiens
  misc_feature 8, 35, 64, 92: n = A,T,C or G
gatctgcnctcccctgtccgatgcctgattgagtnaatgcttgcgcatgctaagacctctggcntaaaacggactagatgccctccgttganagtgaagc

SEQ ID NO: 30222 - DNA, 139 bp, Homo sapiens
  misc_feature 14: n = A,T,C or G
aacaatggactagnatttgccagggcctcatagcagaatatcctgtctgactctctcttcactagactaaggagaaaaaataacaaaacaaaaatgaagaatttattttaaaagatgaatatagcattcccccctcccc

SEQ ID NO: 30223 - DNA, 240 bp, Homo sapiens
  misc_feature 6, 35, 213, 238: n = A,T,C or G
catcanccagactgagtcaagttgttccttaagtnagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgnacagttatctaagttaatttaaagntg

SEQ ID NO: 30224 - DNA, 172 bp, Homo sapiens
  misc_feature 3, 8: n = A,T,C or G
gantccgnagaagaagagtccgtgagtatttcattacttatgatgatgaagggggcggggaagaagacacaggaagcctttgatattgccaccctccagaatcctgatggtatcaatggatttatcccccgcaaagacatcaaacctgagtatcagtacatgcctagacctg

SEQ ID NO: 30225 - DNA, 156 bp, Homo sapiens
cggtgacgtatttttgtccccattttatagatgaggaaactgggtctcaaagaagtttaggtttttgctcagaagcatatagttggtgtgtgacaaatctggaaatcaccccaggaatgtctgactgcaaagcccctcctctcaataaactacaca

SEQ ID NO: 30226 - DNA, 500 bp, Homo sapiens
tatggcccggggttctccgcaggggaacaattttttaaaaatctaattatttttagtgttaggagccatgaaattagtatagtttatttcttgtatataaaactccttttaattaagtgcatggatatttagtagttggtgtgttatttaacgtataagttttttccactgacagttaaatatgtcttattttaattagtacttttacaacttttagatatttctcagaatctgtgtattctaagaatgacttcccttataaaaatttatatttgtcttaaaaaattcttctgagagtcttgtcatcagcttatctgagagcattctaactactatcagtagctactattagtagctcctctcagtagctagaataataccaactaaacctaatgtcccattaaagaaggacattctttgacttataatctagagaatttcattctgactagcatcaatggactttttactttgtatcatgagattttaaatcacacaag

SEQ ID NO: 30227 - DNA, 100 bp, Homo sapiens
  misc_feature 21, 44, 83: n = A,T,C or G
gctactcaagaaggtggaggnggataagatcgcttgagctccangagattgaggttgcacgtagagctgatacatgccactgnactctaacctaggctac

SEQ ID NO: 30228 - DNA, 164 bp, Homo sapiens
  misc_feature 6, 8, 88: n = A,T,C or G
cggagncngtatttttgtccccattttatagtatgaggaaactgggtctcaaagagtttaggtttttgctcagaagcatatagttggngtgtgacaaatctggaaatcaccccaggaatgtctgactgcaaagcccctcctctcaataaactacacatcggcct

SEQ ID NO: 30229 - DNA, 331 bp, Homo sapiens
  misc_feature 15: n = A,T,C or G
ctgatcgttcaaagncatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttca

SEQ ID NO: 30230 - DNA, 370 bp, Homo sapiens
  misc_feature 46: n = A,T,C or G
cactccaggcctattttaatgaagcctatttaatatgctccatagnatggtagacagaagaaaaagagaccagaaaattatgctgatttcttaaaagatgggatccaaaatgcctcattaacatacaggagaaagcactttcttctcaatgtattcctccaaagaactttatctcaaggaggagcatcttggattctgctcttacaattgccgttttagtaaaatatgctctcatgtaacagcaaattaaaattccttaatagcactatccagtttcacacccaccaagtggattcttgtcactattaataaattactgactttttttagaaagtatcctctaatgccaccatcattagagagaaaactg

SEQ ID NO: 30231 - DNA, 267 bp, Homo sapiens
  misc_feature 1, 8: n = A,T,C or G
nctgtgcntccaggtagatgattaatggcatgattgagtcatactgtgtgccacagactgttctaggcacctttacaggtgagtaaactgatacagagagtttaagtgatttgcatgttacactgctaagtggccgagctgggatatagacataaaatgcaaggatgatttttcaagtatgagaattctagcagaaataaacaacaaacatctcaaagtaagttgaagaatgaaatctaaagaaaaatttgccacctcgcacccccc

SEQ ID NO: 30232 - DNA, 232 bp, Homo sapiens
  misc_feature 18, 22: n = A,T,C or G
agaattctagtgtaaagnaagnagaatctaaaaaactatttttaatatcttcagagaaaaatagatactgcatccataaaacaagtatagaatgctataaaaaggaacactcaaaaacaacagagcttatgaatataacaaatattagtaatgaaaaacttaattgaaaatgacaattgaagaaattcccagaatgtcagttataaaagcaaagagatgtaaaataatacac

SEQ ID NO: 30233 - DNA, 404 bp, Homo sapiens
cacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacgagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttatga

SEQ ID NO: 30234 - DNA, 226 bp, Homo sapiens
gtctgccatattatttatgaattgggtgacaactttgtcccaatatatttatgttttaatattgttaaataatgttttactttggcctacacagatttggaagaaatgtctcttaagaagctaattaaataatttattgtactcacgtttgttgaacattttctatgtgcaaactattattccagtgaaggggagtacaatgatgaacaagattactaataaatgt

SEQ ID NO: 30235 - DNA, 417 bp, Homo sapiens
gaagcgtcttattctcattactttacacatttctggaaccttttcctgagactgtgattcttttcctctctgcttctagcagattaaaacttacccatccttcagagcaggggtcagcacactgtcccatgggcccagtctggcctgccatccattgtagtaagtaaagtttccttgtaacatagtcactcccattcatttgctcagtgtccatggctgctttcaggctacaactgcaaagctgagtaattgtaacaaaaagggtatggcccagaaagctcaaaatatttactatctggccttttagggaaaaagttggccaacctctgctgtgaaggtacagctcaagtactgccatctctgtgaagccttcttaactagcccacccggaaaccaaattagaaaaagtgaatctct

SEQ ID NO: 30236 - DNA, 244 bp, Homo sapiens
  misc_feature 7, 104, 107, 125, 180: n = A,T,C or G
gaaggcnttgaggcagccagcgcaggggcttctgctgagggggcaggcggagcttgaggaaaccgcagataagtttttttctctttgaaagatagagattaatncanctacttaaaaaatatagncaataggttactaagatattgcttacccgttaagtttttaacgtaattttaatancttaagattttaagagaaaatatgaagacttagaagagtaccatgaggaaggaaaagataaaag

SEQ ID NO: 30237 - DNA, 432 bp, Homo sapiens
  misc_feature 6: n = A,T,C or G
gaaagnaaaaaggcccaatgaaccccagtattcagagtccaaaaacccccctcctcaaggacaaggtttctcaatcacagaggacaaacaaaagcaccacaagagcgtgtcccgagtcatggtggggaaaaggaatgcagatggactttctcatcttcctgacagaccatacacaccttgagggcaagagctatgcctgtccctctgcatcccccatgacagccatgagagctctgagggggtgtgtttctccaggcatgtggcctacccacccacaccaatgggagaagctgctgctgcactaagcagtggatcatctgattacttctactggcttcggtctccccctcaaatacacagccatccaggccccaaaaaccctagggggaagggtcccttggctcttactcaataatccacaaaatctcattg

SEQ ID NO: 30238 - DNA, 395 bp, Homo sapiens
  misc_feature 9, 38, 75, 99, 103: n = A,T,C or G
gggagcgcnttgagcagaagatgtccatctgatatatncctgtgaaataaactgccagcaaactttctaacttgnattttaactgttaaagcaagagantaanaacttcggctttggacatgtccacattatggactgtcatcttatttttaaaagtcattctttacgtttaaaattttaaaataaaaaccttctgaggtattgatgtagtccaccgtgtaaatgttaccttctctccatgctgccattatgccaaaacaaaagctgtgataaaaaaagtgcttgagagagtgtgttgataagaaagtgatttatttacagatggaagtctttgtttcatgaagctaccaaactttaaaaagaatgtcacccttttttttgtttgttatggaaac

SEQ ID NO: 30239 - DNA, 331 bp, Homo sapiens
  misc_feature 34, 248, 249: n = A,T,C or G
atttcagaaaatataattactgtatttatatatnagttcattgtaaaattgaatattaggctgggcacagcggctcacacctgtaatcccagcactttgagaggctgagacaggcagatcgcttgaggtcaggagtttgagaccagcctgggcaacatagtgaaaccccatctctactaaaataacaaaaattagccaatcatagtggctcatgcctatagtccaagataggaagctgaagcaagaannaaattcacttaagcccaggaggtcaaggctgcagtgagccactatactccagcctgggtgacagagcaagaccctgtttcat

SEQ ID NO: 30240 - DNA, 393 bp, Homo sapiens
gtgtccattcagtatcagtattgctgtgacattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaaga

SEQ ID NO: 30241 - DNA, 355 bp, Homo sapiens
  misc_feature 5: n = A,T,C or G
gaggnctggggtgaattatatgaaattgctgatatttgaccattgtggagtcacaaaagcagcaattttatgtggttgaatatggcattattaaacctacttttgagatgcagaaaagtgaggcttaaagcaaatgtgacttaaaaaaaatcataaagctttcagcagcagagctaaactaagtctcatgactgcgaaattctatgattttcccatattgccactactgaactggcagccagccacccatttgtattttccttaatacaagtaaatgctaattcaaataggatgaaattaatctgatattttaatgactcaaaactgtagatgttaatagctttctgttattttg

SEQ ID NO: 30242 - DNA, 427 bp, Homo sapiens
tatggccgggacccatccatatattaatctcatctgaagacatcctgcactcatgaactatccccttattaggcctcaaaacagatgcaatccccagatgcttaaatcaaactaccttaaccactgggcgaccaggtctttactatggacagtgctcagaaatttgtgaatctaaccagttttatacctattgtcctagaactaatcctcttaaaatatttcaaaacctgatccacatctacactaaaatatcactgtaaagctattcagcatttaccttttaagttaaagattgacggagtctacacctctctgcagtgaatgcctcaactagatacttccacatgatccattattatcctgtcaataatcataactttattctccattattcagttaaaattattaaatttcatttatattatcc

SEQ ID NO: 30243 - DNA, 466 bp, Homo sapiens
caattcgcactaaaaagattggcattatttttctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcacctggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattag

SEQ ID NO: 30244 - DNA, 376 bp, Homo sapiens
ggaatcagaaacctgttttgatatgtgttctccatgagttaagtctgatttgtctttttatttcatgatgcatgtcttttttttcttttgtcaggataacgtcatatagcatcttgtttgtttttccttatctctatgtacatatctatctacttctgactgtagatgggtatatagatagatgccaagcttcttatgttctgggggtagtatgcatcattattgggtctctgccttaaagcacatcaaaattcattttagacaaaaaaacttctgccttgtctttggtcattagggagctctaatgtgtgtttgtggctccaagttacattttgtgtttcattgatctatatgtatatatgtgatgttttcatat

SEQ ID NO: 30245 - DNA, 332 bp, Homo sapiens
  misc_feature 9: n = A,T,C or G
cataccagnaatctctggggcacattcaaagtcagtgtgtagagggaaatttatagcactgactgcccacaggagaaagcaggaaagatctaaaattgacactctaacatcacaagtaaaagaactagaaaagcaagagcaaacatattcaaaaggctagcagaaggcaagaaataactaacatcagagcagaactgaaggaaatacagacacaaaaaacccttcaaaaaaattaataaatccaggagctggttttgtgaaaatatcaacaaaattgatagaccgctagcaagactaatatagaagaaaacagagaagaatcaaatagacgc

SEQ ID NO: 30246 - DNA, 421 bp, Homo sapiens
caataacaaacttgacacgtgacctctaatatacatgtgtggttgtgtgtgtgtatgtgcacttgcattgtagtacagccaagcagtgcagagtatacattttttttcaaatgcacacagtttaccaaaactgaccacatgctgagcggtaaagcaggcatcaaatttcaaagcattgaaatcatatagaccagcagtcctcaaactttttgcactcgggaccactttagtaataattattgaggattaatctcagactcttatcaatgtttaccttattagaaattaaaacacattttttaaagacaagaatatataagtacatgtctcatccattagaacaaagatgttatgtcatatagcttttgagaaatctcactgtacagtcatgggagaatatgaataaaatagacaaataatg

SEQ ID NO: 30247 - DNA, 457 bp, Homo sapiens
  misc_feature 31: n = A,T,C or G
ggctgacgatgggggaccccagcaagcaggncatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccgccaaaggaggaaga

SEQ ID NO: 30248 - DNA, 139 bp, Homo sapiens
  misc_feature 46, 52: n = A,T,C or G
tatggcccgggggaagtcgagtatgattcaatgaaaagtatcactnaaaagnagtattgatcaacaagagaaagaaagaaagaggaaagagaaagaaagagaaggaaagaaagaaaggaaggaaggaagggaaggaagg

SEQ ID NO: 30249 - DNA, 126 bp, Homo sapiens
ctcctgggatcaactgatcctctcccctctgcctcccaagtagctgggaccacaggcatgtgccaccatgcctgcataattttttttagagatgaggtctcgcctcttgtttggccccaagggctt

SEQ ID NO: 30250 - DNA, 107 bp, Homo sapiens
  misc_feature 107: n = A,T,C or G
cgcaggcactgtgtgtgtcctacacaatggtgctattctgtgtcaaacacctctgtattttttaaaacatcaattgatattaaaaatgaaaagattattggaaagtn

SEQ ID NO: 30251 - DNA, 349 bp, Homo sapiens
caggccagtcttgaactctgtgctccacaatcgtccttccttaagctctcaagaagctgggactgtctataatattgactttaattttacttcacattttttggagggtgcttgtctagaggaggttgacaaagaaaattcattattaatgtaaactgaattgcttctccaaaagtaaatgaaaggccgtgaaactgctgtaggaattcagttttgttttaaaaatacaataattttgtgtctattatttgggaagcactgttatgtttggtgagatttatgaaggcttatgatattggccctgccctgacaaaaggtagagttgctttgagatgatataactttactg

SEQ ID NO: 30252 - DNA, 300 bp, Homo sapiens
tgagccctaggattcatctttcttttcaccgtaggtggcccgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgc

SEQ ID NO: 30253 - DNA, 109 bp, Homo sapiens
  misc_feature 31: n = A,T,C or G
cgtatcacattttctgtaatgtcccatttgngtaaagttatcattatcctctataggcatatacttactaagtacctaccagttgtgaaaccctaaatagttaagattg

SEQ ID NO: 30254 - DNA, 305 bp, Homo sapiens
atatgcctacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactga

SEQ ID NO: 30255 - DNA, 142 bp, Homo sapiens
  misc_feature 33: n = A,T,C or G
tagtccaaagaaggaacagctctttggacactnggaaaaaaccttgtagagagagtaaaaaatttaacacccatagtaggcctaaaagcagccaccaattaagaaagcgttcaagctcaacacccactacctaaaaaatccc

SEQ ID NO: 30256 - DNA, 259 bp, Homo sapiens
gttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgct

SEQ ID NO: 30257 - DNA, 379 bp, Homo sapiens
  misc_feature 25: n = A,T,C or G
ctccctggaactcaaggatctccangagcaaaaggggatgggggaattcccggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcaga

SEQ ID NO: 30258 - DNA, 458 bp, Homo sapiens
  misc_feature 7, 31, 58, 101, 220: n = A,T,C or G
gaggccntgaggcagcctgcgcaggggcttnttgctgagggggcaggcggagcttgangaacccgcagataagtttttttctctttgaaagatagagattnatacaactacttaaaaaatatagtcaataggttactaagatattgcttagcgttaagtttttaacgtaattttaatagcttaagattttaagagaaaatatgaagacttagaagagtancatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataatttgaaggcgatcttttaaaaaga

SEQ ID NO: 30259 - DNA, 197 bp, Homo sapiens
  misc_feature 26, 31, 32: n = A,T,C or G
ataactggagtgccaaggctaaaagnacganntaccaccggaaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggtttt

SEQ ID NO: 30260 - DNA, 310 bp, Homo sapiens
gtgaggagctatgggacctagaccaaaaccctggcattttgataacagccccagccagagaggttgtgagatattctgcagctgccccaagttgttttagtatcagagggggtagaaggcagattgttgggttgattcagggttgagtttgtaggctgggggaggtggaaggacaggggatatgagtgttgcaagtgcacaaaatgttactgtttaagggggctcagtggagagaggggagaaacaagaccagggaaagtctttattcattgacagaaaaaagaaagggggtgcagcagaactgaggtac

SEQ ID NO: 30261 - DNA, 356 bp, Homo sapiens
  misc_feature 4, 28, 29: n = A,T,C or G
atcnctgtcaatagtggggaagggtggnntctacagaggaaataaaagagtaggtctgagtagtagaaggataaatgttatgttctttggatttagcaccaaggaagtcattgaagaggagtttcaatgtagagtttcaatatatttattggtagataaagtgggtgtgaggaagtacaggtagtgagagtacttaactcttaagaatctcagatttgctgggcttgcgtgtatagtcccagctgctggagcgctgatgtgggagtatctcttgagatcaggagttaaaggctgcagtgagctatgatcatgccattgcattctagccttgacaacagaatgagacctcatctctt

SEQ ID NO: 30262 - DNA, 370 bp, Homo sapiens
tatcaccatttcctcctttacctttcgtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatg

SEQ ID NO: 30263 - DNA, 425 bp, Homo sapiens
  misc_feature 2, 5, 32, 54, 60, 215, 216, 406: n = A,T,C or G
anaanccaatatattaggccttgctctaattnttatattaaattttaattccgntaaacntttttcttaagtgcacaaagcatcgtactccctggaggcaaacacatcgggctgcttcagcgttagcgggatgcttagcattttgaatattgtggcaaaaaaattaaaagttcacttattaatatttatcagcagtatcataatttccatcctcnnatttcagaatttcacttgaggcaaaaataccacaagtgtaattactctagcacagctattaatgtgctggatgataggccactgcgtcacatgaccttctattgttcatgggtttaaagagaaagcagggctttgtatttctttttcttcttttaaaggcgactgtagcatcttggcttttgtctggggnggggaggatctggggtctg

SEQ ID NO: 30264 - DNA, 392 bp, Homo sapiens
  misc_feature 6, 19: n = A,T,C or G
atctcnttaacattttatnctgttatctttcaatgcattgacaatgcaagggtaatagttgagggtttttgtcaaaatgttggggtaagcaaccaggctaatgtaaagtggaggcaaggaaaatgtttcagtgaaaaggaaaacaggccatgtaaatatattgtcagtgaaaaaaagaaatgaataaataaacatttgataaaattaatgactgaaacagaaaaaatcacgaatgtttttggataataggctataccacagggatatagaattaattgaggaggtgatggtgagggataaaagactacacattgggtatagtggtgtatgctgcttgagtgatgagttccccaaaattagagaaatcaccactaaagatcttatccatgtga

SEQ ID NO: 30265 - DNA, 251 bp, Homo sapiens
  misc_feature 6, 7, 32: n = A,T,C or G
ctaaannaagatataaattatgttagacctanaacttctcatatctgcagcatcagagcatgtgaagtgcaaagccatgtagaacctttgaaatcagctctcttttccttttttttcttacagtgagttttagttagacatgctgtgctgacattctgcatggttgtggctttgctgttttattagatggcattcagagtacaaattgagtaaatggtatttcccttgagaaataatgtgattattctgtt

SEQ ID NO: 30266 - DNA, 194 bp, Homo sapiens
taatctacttaagggattttattttcttagtcttcttgaactctgagggtaatgatatcatttgctgggcagagatattagtgattgtgaaaaggaggatatgggaagtctaggtaaaataagttacttttgtgatttgttttttttgcaagtggtttttgaatatttgataattttaaaatttacttcaacac

SEQ ID NO: 30267 - DNA, 299 bp, Homo sapiens
  misc_feature 7: n = A,T,C or G
aaacacntctttgaagaaggaagggattaattaatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgcat

SEQ ID NO: 30268 - DNA, 394 bp, Homo sapiens
  misc_feature 242: n = A,T,C or G
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgatt

SEQ ID NO: 30269 - DNA, 430 bp, Homo sapiens
  misc_feature 6, 55: n = A,T,C or G
ggcccnttcgtggacgccgggtgagtgatttagttggttggtgttgggccggagnaaagcgggaagactcatcggagcgtgtggatttgagccgccgcattttttaaccctagatctcgaaatgcatcgtgattcctgtccattggactgtaaggtttatgtaggcaatcttggaaacaatggcaacatgacggaattggaacgggcttttggctactatggaccactccgaagtgtgtgggttgctagaaacccacccggctttgcttttgttgaatttgaagatccccgagatgcagcttgatgcagtccgagagctagatggaagaacactatgtggctgccgtgtaagagtggaactgtcgaatggtgaaaaaagaagtagaaatcgtggcccacctccctcttggggtcgtcgccctcgagatga

SEQ ID NO: 30270 - DNA, 111 bp, Homo sapiens
gctgtcactgtcatatctgtctaccatcaatggagatactaatctctctccactcttcatgctgagatatggaaaatatccttcatttaactacatgcagtagaactttca

SEQ ID NO: 30271 - DNA, 411 bp, Homo sapiens
agaaacaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattataagcacaaatttgaaggaaaga

SEQ ID NO: 30272 - DNA, 390 bp, Homo sapiens
  misc_feature 8: n = A,T,C or G
acacaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctg

SEQ ID NO: 30273 - DNA, 488 bp, Homo sapiens
  misc_feature 5, 352: n = A,T,C or G
aaganccctaggaaaagacattttctgtttttgagaatttccaccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctntactaaaaatacaaaaattagctgggcatggtggcgcatacctgtaatcccagctacttgggaggctgaggcaagagaatcgcttgaacccaggaggcagaggttgcagtgagctgagatcatgccattgcactcc

SEQ ID NO: 30274 - DNA, 264 bp, Homo sapiens
  misc_feature 32, 34, 58: n = A,T,C or G
atgaaccactattttgagaacatgcacaatantntgtttttattactggtttaatggngtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatg

SEQ ID NO: 30275 - DNA, 327 bp, Homo sapiens
  misc_feature 7, 33, 34, 35, 318, 322, 325: n = A,T,C or G
aaacgcnccaaatctatcagcggatagaatgtnnnaacaaaatgtgttatatccatacaatgatgattattcagtaataaaaagaaatgaagtactaatatttgctgcaacattgataaaccttgaaagcatgctgcgtgaaggaagccagtcacaaaaaaccacatactatagacttttcctgaaagtccagaataaggaagtctatatagagacacaaagtagatcagtggttgcttagcgctggggaagagggaaagttgggcatagaggaatgatagctaatgcgtataagatttctgattttttttttttttnaaanggngt

SEQ ID NO: 30276 - DNA, 292 bp, Homo sapiens
  misc_feature 30, 220: n = A,T,C or G
gttggctttcggaactgaggccatgattantagggacggccgggggcattcgtattgcgccgctagaggtgaaattcttggaccggcgcaagacggaccagagcgaaagcttttgccaagaatgttttcattaatcaagaacgaaagtcggaggttcgaagacgatcagataccgtcgtagttccgaccataaacgatgccgaccggcgatgcggcggcnttattcccatgacccgccgggcagcttccgggaaaccaaagtctttgggttccggggggagtatggttacca

SEQ ID NO: 30277 - DNA, 450 bp, Homo sapiens
  misc_feature 29, 32, 172, 353, 376, 416, 428, 444, 449: n = A,T,C or G
gctttctttttgaggaagacgcggtcgtnttngctgaggatttttggtccgcacgctcctgctcctgactcaccgctgttcgctctcgccgaggaacaagtcggtcaggaagcccgcgcgcagcagccatggcttttaaggataccggaaaaacacccgtggagccggaggnggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaanacgtgggatcgtttccagatganaattcacaagcgactcattgacttgcacagtccttctganattgttaagcanattacttccatcagtnttganc

SEQ ID NO: 30278 - DNA, 437 bp, Homo sapiens
  misc_feature 8, 32: n = A,T,C or G
gagaccgnacttcgctcgtactcgtgcgcctngcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaaga

SEQ ID NO: 30279 - DNA, 428 bp, Homo sapiens
  misc_feature 17, 30: n = A,T,C or G
agccgtgctccctaagnattttgaaaaggntgccttttctttttgatcatctgaataaaccatattgtaactaaacctgctgtatgatttagatgccgtattttctttgtatttgtagttgagaattggcaccacgtaattgccaaaatgacagcatttaacgtttaatgtgctgttaggcacgcctggttgccactgggttggttgctcctaaagtcaaaatcatagtaaccgttcttggctgccactgttcagcagatgactgtttacccaggagtctgaacactagcaatgctcaaagaacaaaattgtcctaaatgactttaaaatacatattttaaactctttatgtaacagtgatgagctctggtgcatttgctcctgtggatgcctgggattcaggggtccagacagcatagggtatcaag

SEQ ID NO: 30280 - DNA, 110 bp, Homo sapiens
  misc_feature 105, 106, 108: n = A,T,C or G
gcgaaattggggcttcctctgctctggtgacccagaaccgtcaactgaaatgaccctgtctgtgtagtactccggcaggatgggcctcggagcgtaaaggcggcnnanac

SEQ ID NO: 30281 - DNA, 388 bp, Homo sapiens
  misc_feature 25, 53: n = A,T,C or G
attaaaaggcaatacaatgaatganttttagatgtttcaagtggaataccagntgaaagtgacatttccataaaaaaattaaactaagtaaagtcttgttcaaattgtaacactagtagtctgacaaacacaaataataaaacaaacaaaccaccctggcacagattttcactttgaaacaaataattaaatttttggtaagttttttgagggaagaaacgtaattagtttatttttagctctaaacttctaggacatttttttctaaagtgagtttacttgtactttttctttatttggacaatagttcccaatggtttactttgattttgatgatttgatttcaagccatttatctatttcatttgtgtggagtaaaacaatattg

SEQ ID NO: 30282 - DNA, 400 bp, Homo sapiens
  misc_feature 5, 30, 32: n = A,T,C or G
atggnccgatccagtagatcgtggtggatntngtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtgggaagtatacctggctttttaaaatatatgtattt

SEQ ID NO: 30283 - DNA, 304 bp, Homo sapiens
  misc_feature 5, 30, 32: n = A,T,C or G
ctgancgattggatatgaagtgaggaaagntnagaaatccacaaagattaaaaagccggtgtggtagagggaaaactaggagagtcttggaaaccaaaatttaaaagtgaaagagagactgttgaatgctgcagaggaggaggatgaaaccttagaattgacagtgaatttggttacatgaaggtaattggtaaccttgataataccattcttgggttgggatgttgtaaagagaaatttagaggtaaggaagcagtaacaaccattggcaatactttgacgaagttctgcattgaagaggaac

SEQ ID NO: 30284 - DNA, 124 bp, Homo sapiens
  misc_feature 20, 25, 32, 41, 59, 65, 100, 120: n = A,T,C or G
ctgtagtcccagctactcangaagntggaggngggaagatngcttgagccccaggagantgaggntagcacgagagcttgaacatgccactgcactctancctaggctacagagcagganccca

SEQ ID NO: 30285 - DNA, 352 bp, Homo sapiens
  misc_feature 25: n = A,T,C or G
tctagctttcaaaaattagtgaagntcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccaga

SEQ ID NO: 30286 - DNA, 431 bp, Homo sapiens
  misc_feature 18, 25, 101: n = A,T,C or G
caggctgtcttccagagnggctgcntcattttgcatttccactaacagtgactgggagttccttatgctaaacatcctctacagtatttggtgtggtcagngttatagattttggctattctttcaggtgcatagtggcatcttattgttgttttaatttgcaattccctgatgatgtatgaggggacttcaaaaatttatggaaaaattgaactaaaaggtaaaagtaaaaaatataaacttcttaacataagctccatcgagttcaagatactttgtaagcaatgataccagccatttggttcatccctaaggaactgagggttctgagaatttaatcaggtcaatgaagtctttttcacgttatgaactgaagaaaaatgtgtgcaatttaaaggtttgttaagactttgaaacaaaaagaagtcaga

SEQ ID NO: 30287 - DNA, 386 bp, Homo sapiens
  misc_feature 6, 11: n = A,T,C or G
agtccnaatcngtatatgctagttgagcattggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattg

SEQ ID NO: 30288 - DNA, 391 bp, Homo sapiens
gagggcagacaatttagtcttttgtgttcttttctatacccaaacatctagaacagtagcacaataagtagttgttgaataaatgtcttttcttaaagaaaaaatgaaaaaaggggccaggcatggtggctcatgcctgtaatcccagcactttgggaggctgaggcgagcagatcacaaggtcaggggtttaagaccagcctgaccaaaatggtgaaaccccatctctactgaaaatacaaaaagtagtcaggcatggtggtgcacgcctgtagtcccagctgcttgggaggctaaggcagaagaatcccttgaactcaggaggcagaggttgcagtgagccaagatcgtgccactgcactccagcctgggcaacagagcgagactccat

SEQ ID NO: 30289 - DNA, 314 bp, Homo sapiens
gtcataccaggaggtgctggggtattggctttggattggttggtttgcctatgaaaggagtactcaaaggtgagtttactatctctactgaaaaagctaatcctggcaggggcagtccctccagtgtcagcaaggaccctgatgtcaaaacatcaaaactatagaaagtaaaaagacatgcttaatacagaagttaataaaggttaaagcagaaatatatgaaagagagagcagaaaaacaatggaggaaatcaatgaaaccaaaagcagttctttgaaaagataaaaaaattgactaactttagctagactga

SEQ ID NO: 30290 - DNA, 329 bp, Homo sapiens
gcgacgcaagatggcagccaccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagagtggacccaagagccatatcagtgctagcaaaatggcagaattcatatagcatcaaagtcgtcctgcaagagcttcggcgcctaatgatgtctaaagaaaatatgaaactccctcagccgcccgaaggacagtgttacagcaattaat

SEQ ID NO: 30291 - DNA, 346 bp, Homo sapiens
  misc_feature 7, 24, 30, 31, 33, 34, 174: n = A,T,C or G
gggctcngctggtggcgttcaagnatgtcnntnnagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcacntgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaat

SEQ ID NO: 30292 - DNA, 241 bp, Homo sapiens
cgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacccgaaaaaaaaaaaaaaaaaaaaaaa

SEQ ID NO: 30293 - DNA, 469 bp, Homo sapiens
atctgaatcgagcagaaaaatcttttgacaaaattcaataccctttctgacaaaaatcactgaacacataaggaataaaaagaaactacttcaacatagtaaaagccatatatgaaaaacccatagctaacatcttactggtgaaagaccaaaagcttttcctttaagattgaggatgagataaggatgcctgcttttcaccacttctattcaacatactactgaagttctagctagaccatttaggcaagagaaagaaataaaaggcacacaaattggaaaggaagaggtaaaattatctctgttcatagatgatatgaccttgtagatagaaaatcctaaagatcccacaaaaaactatcaatgctaataactgaattaaacaaagtattggggcacaacgtgaatacacaaaaatccgttgcatttttatacacaaacaaacagtgaacaatctgaaaaggaaatt

SEQ ID NO: 30294 - DNA, 305 bp, Homo sapiens
  misc_feature 13: n = A,T,C or G
cgtctgcgaaatntatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagcaatcttggaatataaagaatttcttcaggttgaattacctagaagtttgtcactgacttgtgttcctgaactatgacacatgaatatgtgggctaagaaatagttcctcttgataaataaacaattaacga

SEQ ID NO: 30295 - DNA, 470 bp, Homo sapiens
caggcactggagcctttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgataaacttttccaatggggaaattatagacatcttcaagccagtgcgcaagcactttgatatgcctcatgatattgttgcatctgaagatgggactgtgtacattggag

SEQ ID NO: 30296 - DNA, 456 bp, Homo sapiens
gaactcccgggttcaaacgatcctcctgcctgagcctcccacagtgctgggattccaggcacagcccccgcacctgacctggaaggtttttactcagcattattctctggaagttcctccaggcctttgtggggatggtttgttcctttctgctgctgagtagtattctgggtgtggatgggccacactgtttgatgattcagaggctgagggatgtctggattgtgtccggttctgggcagcttgctgtgaacattcactgactggcccttccttttgccctctgtgcagagggcccgagcagtccctctggttagataaggcagacacaatgtcccaatacataatttaacaggctctttgcagcctggagacgatgtaatgggttaccaggaaaaaccatttgagttcaagttccagcaacttttcaaaaacaataaaacaaaataaaaaaca

SEQ ID NO: 30297 - DNA, 253 bp, Homo sapiens
  misc_feature 17, 248: n = A,T,C or G
gggatttggagaccagnataaataaagcatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaanaaaag

SEQ ID NO: 30298 - DNA, 463 bp, Homo sapiens
atctttcgacttgaaaaaatgaatcatccagatcttctgataaaagtacttgggattttaaagaaaaatgtattatatgtagatgtggaatctgattttcacgctaaagttcctgttgtggtgtgcagagatcgaaaaagtctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaa

SEQ ID NO: 30299 - DNA, 187 bp, Homo sapiens
  misc_feature 4: n = A,T,C or G
gatncaccactgcactccagcctgggcaacagagtcaaaaccctgcctttaaaaaaacaaaaaaacaaaaaaggccgggctcggtggctcatgcctataatactttgggaggccgaggcaggtggatcaattgaggtcaggtgttcgagaccagccaggccaacttggtgaaaccccgtctctacta

SEQ ID NO: 30300 - DNA, 401 bp, Homo sapiens
atcctaagttggtaatggcacatcttatagttgatggcttaaatctgataaaattgttaatcatgtcgtttatgaatgtacagtgctttgcactttataaaacactttccaatcagatactccatttgaatctcaaaggtcccctgagaatgaggcctgctgctgctgtcacctttattttaacccttgcccaaggtcatatagctaattagggatgtgttcaaaattacaacccagaacttttgcttcttggtggtgacgtgtgactttaccctgctgttgagccagtctgggttaattgggaatggggcaagagttagatcggatttgatttcagaactatgctgaagatgctggatgatggggattttgtacacgggtagagtgtaactcataagaac

SEQ ID NO: 30301 - DNA, 452 bp, Homo sapiens
cagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatggattggcacattgtattacttactgcaagagatatttcattttcagcacagtgcaaaagttctttaaaatgcatatgtctttttttctaattccgttttgttttaaagcacattttaaatgtagttttctcatttagtaaaaa

SEQ ID NO: 30302 - DNA, 391 bp, Homo sapiens
  misc_feature 5, 16, 36, 37: n = A,T,C or G
tttantggcccggganatgtattcactacctgtacnntaaaatatgaaagtaccccaaccatttataataaactctacataaaataccaaagtaccccaaactgtgtattatatacctgtccataaaatatcaaagtacccaaaatatatattgtaaactgtacataaaataccaaattacccaaactgtgtattttatacctgtccgtaaaatatcaaagtacccaaaatatatattgtaaattgtacataaaatatcaaagtagccaaaatatatattgtatactgtacataaaatataaaagtaccccaaatatatattatatactgtacataaaatatcaaagtaccgataatacatattatatactgtacataaaatatcaaagga

SEQ ID NO: 30303 - DNA, 500 bp, Homo sapiens
  misc_feature 2, 15: n = A,T,C or G
tntatggcccgggcnaaggatgttcgtcgtggcaaccgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggga

SEQ ID NO: 30304 - DNA, 250 bp, Homo sapiens
  misc_feature 2, 15, 35: n = A,T,C or G
tntggcccggggtanttttgtattttttgtagaancggatttcgccatgttggccaggctggtctcgaacaccctgggctcaactgatccgcctgcctcggccctcccaaagtgctgggattacaggtgtgagcccacccctgctcaaccaggttttattatttaagttagttaaactttggatagattgtataatatatagtttaatgtaatcatgctcatattttttaaataaataaaacactacaaa

SEQ ID NO: 30305 - DNA, 258 bp, Homo sapiens
  misc_feature 16, 62: n = A,T,C or G
tatggccggggtgccnaagtcagtgcgcgagttcctggagaagaactatactgacgaagccnttgaaacagatgatctgaccattaagctggtgatcaaggcacctcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacaaaaaaaaaaaaaaaaaaa

SEQ ID NO: 30306 - DNA, 244 bp, Homo sapiens
  misc_feature 5: n = A,T,C or G
caganctccttgtagaaatggctgatgctaaggctggggtagggaagtacaaggtgagcccagagtgctgtgtggtgccagaaagcaaggaagcatttaaaaaatgacagggacatgtcaaaggacacatcaatcaacttcaaggggcttccactggccaaatctgggatgatgtgagcatccaaattaataatgataatggtagattatagtctattgaataaaatgagaacctataacaaaa

SEQ ID NO: 30307 - DNA, 498 bp, Homo sapiens
  misc_feature 13, 14, 40, 93: n = A,T,C or G
cgggacctcggcnntttattggcccgggactgccaaaganctctccggaaaatgtgggccccctcccctattgacaatggggacattacttcnttcccgttgtcagtatatgctccagcttcatcagttgagtacccaatgccagaacttgtatcaacttgagggtaacaagcgaataacatgtagaaatggacaatggtcagaacccacccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtccttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgta

SEQ ID NO: 30308 - DNA, 235 bp, Homo sapiens
  misc_feature 4, 17, 18, 21, 23, 27, 28, 34, 43, 65, 71, 107: n = A,T,C or G
gganccggcgccaaganngancnaganncgaaancatttgccnaagaaatgttttcatttaatcnaagaancgaaaagtcggaggttcgaaagaacgatcagatacncgtcgtagttccgaccataaacgatgcccgacccggcgatgcggcggcgttattcccatgaccccgccgggcagcttccgggaagcccaaagtctttgggttccggggggagtatggttgcaaagctg

SEQ ID NO: 30309 - DNA, 479 bp, Homo sapiens
gaaattactggtgtatttagtttattctttctgtgatttttttcttataactattgctggttaatttattatccgtgttggtaaagtgtcttcttatgacttaagacactgtaaaaaatctctttctgctatattctcttttagaattgaaaattggcattacttctagggtagtgtgaggaaataatttttgttactgctttatttagaagtaacaatgttgcttttctttttcacatttctaatatgcatttctcattaaaattagtatcatttagcacagtgggcagggtgtggtgatttacgcctgtggtcccagcactttgagaggctggggtggaagaatcacctgaagccaggagttcaagactagcctggacaacaaagtgagaccttatctctacaagaaattaaaaaaaattagctgaacgtggtggtacatgcctgtaatctcacctactcagaaggctgagacagga

SEQ ID NO: 30310 - DNA, 485 bp, Homo sapiens
  misc_feature 1, 20: n = A,T,C or G
naactcaatactaccaaagnatatgtttgggaataagatttatatgaaccatcttctgatatattccttacaaattttatacagttcattttgtactatacctttctctaatgatgcctacagcagttgtgaatgcttaacccatttatgcctgaggctgcaattttttgaatttctgcatgagtgaaaaatcagaccttggcgatgaccttgagcagtaggatataaataactgcatgcttagcattccaataatggaacactaggcataagggggccaagcttgacaggagcattgaagagctgtttatactaccataattggtagcagtgagcatagacagttgcaagcattgttaactgttgagaacaaaacatgtttagccaggtatctccataggaaatctatagtgatctatattcccaacttctcttgtccaactactctgtccatcttagaaaacattacgtctacagaaaaacat

SEQ ID NO: 30311 - DNA, 475 bp, Homo sapiens
cagctataaataaaaatgaattgctaatgcattcagtctagtgatgaatctcaaaattatagtgtttttgaagagagctgaagagacacaaaatggaccatattctacacttccatttatattaagtttaaagacaaggaaatattctgcagtgatagaaaccagaatagtagctgattgtagagtacaagaggactgattggaaaggagaacattccagagagaggaagtgtattataccttagcctggatgatgattgcatggtcatatacacttgccaaattgcattgatccatatgtttatgatttgcattatttgtatataaattatacctcaataaaatgctgttaacataaaaaaattgcccagcttctgagttcttgcttaataatattagtatcacctgttgctgttctacgttaactcaggagctaaattcaaattcagtgtatgacaaaatcttatttgtgtga

SEQ ID NO: 30312 - DNA, 485 bp, Homo sapiens
ttatggccgggggaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaaccta

SEQ ID NO: 30313 - DNA, 112 bp, Homo sapiens
  misc_feature 15, 16: n = A,T,C or G
caccctcgtcaaganncccaccagagtctccgtgcagcggactcaggctccagctgtggctacaacatagggtttttatacaagaaaaataaagtgaattaagcgtgaaaaa

SEQ ID NO: 30314 - DNA, 472 bp, Homo sapiens
  misc_feature 27: n = A,T,C or G
cagttcaacccagccttctttcagaanacggtcacccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggcttttgaagactctgtccgaaagtttatctgccatgttgtgggtatcacttaccagcacattgaccgctggctgctggccgagatgctcggggatctgtcggacagccagctaaaggtgttggatgagcaaatacggctggagtgccgacgagtcggggcagatcttcatctgtagccaagaagagagcattaaacccaagaacattggggagaaagattgactttgacagtgtg

SEQ ID NO: 30315 - DNA, 299 bp, Homo sapiens
  misc_feature 5, 7: n = A,T,C or G
ttggntngggggaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgagacacctcctctgaactgttactgcctgaatggagtcctggacgacattgggtttttcctctaggagaatacaagccttaataaacaatactatttagtaaaaaaaaaaaaaaaaaaaaaaaaaa

SEQ ID NO: 30316 - DNA, 252 bp, Homo sapiens
  misc_feature 3, 4, 9, 18, 26, 27, 37, 38, 47, 56, 68, 75: n = A,T,C or G
gcnnttganggtcagccnaggtgccnntcacctgctnntttggatgnaggcctttnccagaactaccncctggcnaataaagtttttggtgccctgaagggagctgtggatggaggcttgtctatccctcacagtaccaaacgattccctggttatgaattctgaaagcaaggaatttaatgcagaagtacatcggaagcacatcatgggccagaatgttgcagattacatgccgctacttaatgaaaaaaa

SEQ ID NO: 30317 - DNA, 124 bp, Homo sapiens
  misc_feature 3, 14, 27, 29, 42, 77, 90, 97: n = A,T,C or G
ctnccccctggggnaaactccggccantntaatgggccctgnaggaatcccggccgccctcggcccagtcgaactcntagaactcgagcnagcttantgcatgccggccgcaattcgagcctca

SEQ ID NO: 30318 - DNA, 473 bp, Homo sapiens
  misc_feature 13: n = A,T,C or G
atggaaaccaatngcaaaatccaaaatgtaagacattctacaggacaaatgactgaaataagtggcaaaagataaaaaagtgggaggactatcaaaaaattaattaacagattaaaataaattaatacttaaagacatttcatccagatagtctggatcttgatttgaacaaagcaactttgtaaaaaagaactttgagggagtcagagaaggttaaatatggaccaattattagacaatattaaagaattactgataattttaacatgcgataatagtattgtgataatggttaaaatgagcttatctcttagaaatacaaactgatgtatttacaaataaaatgatataatgtctgagatttgcttgaaaatagtccagctggggagaaggaaaaaaacatgtttgaaaagtacaatgaaataaggttggccatatgttgataaatattaaatctggataacagaggcatg

SEQ ID NO: 30319 - DNA, 102 bp, Homo sapiens
atggcagattgaaaaggatctcattcctgggaaaaaaaaaaatcctgtcttgttcataaattgacaatgtcaataaattgaaatatggttcactgcccaaaa

SEQ ID NO: 30320 - DNA, 158 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgc

SEQ ID NO: 30321 - DNA, 110 bp, Homo sapiens
  misc_feature 5, 6, 10: n = A,T,C or G
gagannaganaatcgatggaacccaggaagcagaggttgcagtgagctgagatcatgccgctgggctccagcctgggtgacacaatgaggctccatctcaaaaaaaaaaa

SEQ ID NO: 30322 - DNA, 258 bp, Homo sapiens
  misc_feature 2, 5, 70: n = A,T,C or G
cngancgctccagcgcctggatctgcaccgtgcccttgtagaggatcccttaccgtcctagagagcagancgctttctgaaaactacttgctccaaaagaccctctgagttaacgtttcagctgtatcattagacttgtatttagagcgtgtcaccctcctctgaactgttactgcctgaatggagtcctggacgacattgggtttttcctctaggagaatacaagccttaataaacaatactatttagtaaaaaaaa

SEQ ID NO: 30323 - DNA, 317 bp, Homo sapiens
  misc_feature 5: n = A,T,C or G
gaccncgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttt

SEQ ID NO: 30324 - DNA, 413 bp, Homo sapiens
ggccttactgcaggaaaagtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgggcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaaga

SEQ ID NO: 30325 - DNA, 473 bp, Homo sapiens
  misc_feature 10, 418, 434: n = A,T,C or G
gaaagaagangttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaaatcattgctttgaagcagttgtgtcagctactgcggaaaaggaaggaaactcctgacagtcttgtgcttttcctatttgttttcatggtgaaaatgactggagaatttttgggnattacactggaatttngtatcctctgaagcatgtttcatgtttttgtgactatat

SEQ ID NO: 30326 - DNA, 475 bp, Homo sapiens
  misc_feature 3, 8, 23, 25, 32, 50, 56, 63, 79, 83, 466: n = A,T,C or G
ganttacntcttcttttaagccnangggagangccctttgaccccaaganactcantcagtcnaggttctacttgagcnaganaaagtgggtaatggtgcccatgatgaagtttgcatcaccctgactatacccttacttccgggacgaggagctgtcctgcaccgtggtggagcctgaagtacacaggcaatgcccagcgcactcttcatcctccctgatcaagacaagatggaggaagtggaagcccatgcctgctcccagagaccctgaagcggtggagagactctctggagttcagagagataagggtgagctctaccctgccaaagttttccatctcgagggactataacctgaacgacatacttctccagctgggcattgaggaagccttcaccagcaaggctgacctgtcagggatcacaggggccaggaacctagcagtctcccaggtggtccataangctgtcttg

SEQ ID NO: 30327 - DNA, 218 bp, Homo sapiens
  misc_feature 211: n = A,T,C or G
ggaagttgaaatgcctccttcaatatcactggtctcaaattcattgatagaattttttcttaaactaataagtggggtaagtataatctcctaaattggtacccaccggctgctcctaaactggtttccagtcatgtcctccagtatgtgatttttataaattaaaggtaatattgtatattaaagttcaaataaagatgttctttaagcnaaaaaaa

SEQ ID NO: 30328 - DNA, 279 bp, Homo sapiens
gtggctcacgccctgtaataccagcactttgggaggtcagggtgggtggatcacttgaggtcaggagtttgagaccagcctggccaatatggtgaaaccctgtctctactaaaaatacaaaaattagctgggtgtggtggtgtgagcctgtagtcccagttccttgggaggctgaggcaggagaatggcttgaacccaggaagcagaggttgcagtgagccgaaattgtgccactgcactccagcctgggtgacagagtaagactcttctcaaaaaaaa

SEQ ID NO: 30329 - DNA, 374 bp, Homo sapiens
  misc_feature 34: n = A,T,C or G
ttatggccgggagcctgaactgagtgagaaaganactagcaatttggggtgggatgggaggtgggggcgagggtgttatcatcatcattggaatgctggttaaaagttctgagagcctaaagaagtcacagcagagtactaagactggagcttttggagaagttcacaaaggatgggaggagccagcatggaagatgaaagaggagaagcagcggtcagtgaagtaggatgctgtagtgtcaggaaaggtcagatgtggcagagagatcaaggagagtgaggcagataattggctgctgaatcggtttagaagttcattgcaggcctttgagagaaattttgtggggcaaaagtgagattgtatttgtgttttg

SEQ ID NO: 30330 - DNA, 470 bp, Homo sapiens
aatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttattcggttggggatcttttctgtcttctgggttccattttttaaatgtttaa

SEQ ID NO: 30331 - DNA, 264 bp, Homo sapiens
  misc_feature 257: n = A,T,C or G
ataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtnaaaaaaa

SEQ ID NO: 30332 - DNA, 470 bp, Homo sapiens
ggcagaaactggccttcctctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagac

SEQ ID NO: 30333 - DNA, 323 bp, Homo sapiens
aagccctggaaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccaccagaagatccacatctcaaagaa

SEQ ID NO: 30334 - DNA, 466 bp, Homo sapiens
agaatatgagctcttggaggacaggagctgttgtacttctttgtcttttggctctaatgcagtgtactgccctgagggattaaataagacgccgcctgcgccttcaagaagtttgcagccagcgaggggaagacatgaggctgtactaggcactaggtttctacaggagtctgtgcaaagagaagaaaaaagaaccctgagcctaaacagtgggtgtggccagttctccctaagggatacagcgagggtaatcttgaggccagcattggggcaggtgtttcagtcacggggggccttatgaaaaaacgcacaggggctcaaaacagctgtggggacagcaaggaattgcattcgcctgagattgaggttcctataagaaagaggcaatgaaagacatggttggggaaagaaaagcagaggccaggacgggtcttctaccaaactaagaattgctgttgtgttcatc

SEQ ID NO: 30335 - DNA, 478 bp, Homo sapiens
gaggcattgaggcagccgcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatcttttaaaaagagattaaaccgaaggtgattaaa

SEQ ID NO: 30336 - DNA, 394 bp, Homo sapiens
ggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtat

SEQ ID NO: 30337 - DNA, 435 bp, Homo sapiens
gttgtagtgtaattgaagaccttgatttttaaaaggctagctgagagaaaagacatcttttctacataaatgtgaaaattaggttgatgatagacttgtaatttggtgacaatagatgccagaaggcaatggagtaatataccagagtgctgagctgataaaaaagatattatttttaattttacagttctatacccagctaaaattcaatacttttacacagtggcagtttaccactgtcatgcttttgttgaaaaagaaaatcctttaaaaatgtgcttcaccaacaaaatataaatgtagaggtaggagtgatattgtaagattcagaattatgatggtagttaactttgaattttataatgataatagaatagcaatacctttcatattataatttacttacatggaatgaaaacctcagacagtaatgac

SEQ ID NO: 30338 - DNA, 480 bp, Homo sapiens
  misc_feature 13: n = A,T,C or G
cacagcagctagnaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaaggagaagaaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaa

SEQ ID NO: 30339 - DNA, 482 bp, Homo sapiens
gtgtcctatggacgtgactgtttccaccgagtcgtcctgcaaccgctctcgcgcgtgctcgggcctcagactgtacagcggctctgaccagacgggggaggaagatggagggcaatagtaggtgaaagaactcggagaagccatgatcaggagagcagcagacagtgtgtaggactctgcttcgttaagcaacaacgcgcattgaaactcgagcgggctaaagcgctacggcgagcggatagaggcaaaaagattttgaacgcgaatgtctcctcccgcctacccgtctttcgagtgggttactgagatgctgccgccccccattgggcagaggagctgctgcaagagcgtagagtcctgaagcgcaagggtgtctacatccgaatttcgtttcagcgagatggcgtaggacgcctcggtttgttacgcaaattgttaaagaactgtaacattctgctaattctcacttaattgtaatgcaa

SEQ ID NO: 30340 - DNA, 100 bp, Homo sapiens
  misc_feature 2, 12, 28, 51, 82, 94: n = A,T,C or G
gnaagaatacgngtcatttaaagcctanttaacgcatttactaaacgcagnacgataaatggaaagattaattgggagtggngggatgaaacantttgga

SEQ ID NO: 30341 - DNA, 239 bp, Homo sapiens
  misc_feature 9, 10, 41, 85: n = A,T,C or G
aattcggcnnttatggcccgggccatgacgccagggagaanttgcgtcatttaaagcctagttaacgcatttactaaacgcagancgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaaaa

SEQ ID NO: 30342 - DNA, 467 bp, Homo sapiens
ctattatctgcactaaaatacaccaataatattttagaccattcatggctaaaggaaacagtcaatgaaacaataaagttgtgctaaaaagaaaaaaattcaccctgctttgtgttttacatttaaatttaagcttgttaaaattaaataaattttaaaattctgttctttaccatatttgcaacatgaacttaatagccatatgtggctactgggcttttattggatggtatagttctgaattgtatactccttactctaattgctattatctatttatctatctcccccatacacatgtatctatacacacatacgtacatgcaaatgtatatacgcatatgtgctcttccaccgtttatcaatatcttaatttcattaagcattatcaaacatttcatgaggtcgctttcattttatttcaagtctttaattacaagcatctacagacagaatcatttttggat

SEQ ID NO: 30343 - DNA, 480 bp, Homo sapiens
  misc_feature 2: n = A,T,C or G
cnttatggccggggaaacattatgtccttttctctttgaggacttggtttcacagtaattttattattagagtagtcacataatgttcactttatattttacaagaatattgagccttgaagtagtcaggcgatgaacaagcacagagcataagagtaataagaattgtatccagcaatgtgaaggcatcttagttaccaagaccaccagcagagaacaataaactagtttgatttaaatctcctccatttcctgtgcacgatcaggaagcccaacttccccctgaattcctaggaatccctcctgttaaaaaatagtgcattgtagtctatatacttgcgtttgtattttaaaatggttgtagtaagggagtgctggaaatgttccttctttttgtcatctttatagataagcacatggcattgttatgctgtttctaatggcttaataacacgagggtcactcggacacagtttagaa

SEQ ID NO: 30344 - DNA, 462 bp, Homo sapiens
  misc_feature 24: n = A,T,C or G
gagaagaggtggacatcctaccgnagaccttccttctccaatccttctagatcattctagaatagaagccttcagcctctattctaaataagtgttgaatatttaaaggatataatagtcaaattctttaaagatcaggcatgtatcataagtaaatctagatgtaaggtaatagggcacgattgagtctctgaaaaagtggagcaaatgccatttactctttagtaaagacatttccattcaaatatttaaaaattgtgtcagccaaaaattaaaattaaaaaatgcccacctttgtgctagagtcagctcatagtggactgcagttgggatttctggattttttgtttgaaagagtgccctgtgaatgtcttacccacagtgtctgcaggaccctggcaggcccagtttggaatcctactcaagccctcctcctcatctgtaagagttaaggctactttg

SEQ ID NO: 30345 - DNA, 452 bp, Homo sapiens
  misc_feature 379: n = A,T,C or G
atagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctctactctcaacccctttgtaatggtttgggggcagactcttaagtatattgnggagttttctatttcactaatcatgagaaaaactgttcttttgcaataataataaattaaacatgctgttagc

SEQ ID NO: 30346 - DNA, 165 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgaaaaa

SEQ ID NO: 30347 - DNA, 473 bp, Homo sapiens
  misc_feature 6, 7: n = A,T,C or G
gaagannaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagaagaaagtacggcaagtccctgtactattatatccagcaagacactaagggcgactaccagaaagcgcttgctgtacctgtgtggtgggaaaatgacttgaagcccgacacggcctggagcgtccagaaatggtgctcaccatgcttccagctaacag

SEQ ID NO: 30348 - DNA, 433 bp, Homo sapiens
gggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaa

SEQ ID NO: 30349 - DNA, 465 bp, Homo sapiens
aatatttatttcttaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtggggggggggagtctcacagtgcctttggaagggcccgaacttgccttaaatcttcctcaaccaaataagtattttattagtgcttggagagaatctgaatgtaggaatggggttcaactgcacaaaaggaaaagatttttaccactttttttatat

SEQ ID NO: 30350 - DNA, 119 bp, Homo sapiens
atcccttaaatagaagtgtgagattgggtctaaaaaagagagaggaataaacaaaaagattaaaaagcaaaagaacggaaaaaaaaaggcaagcaagtaaatgtgagcaaaaaaaaaaa

SEQ ID NO: 30351 - DNA, 469 bp, Homo sapiens
cagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctct

SEQ ID NO: 30352 - DNA, 471 bp, Homo sapiens
  misc_feature 10: n = A,T,C or G
gttacatagnaaactaggttttacagaaaaaccgttgacagtagcctactaggaagatttacagttgagtgattcttctaccaaaatcaagcttaactgtattaagctagaaattttggaactggagaaaactttgcttgggtagaacaatcatgggtaactaatgaacagcacttaaaagtagaggctgattttcccataacagggattcatcttaaaataccacgatgtaaaaacaggagatggatttaaccacctgagtgtccataaatggatgaatgcataaagaaatgtgttttacatacacatgatggaatactatttagcctttacaaggaggggggggaatcctgtcatttgtgacaaggtggatgaatctgaaggatgtattaagtgaaataagccaggcacagatatattaatacaaataccacatgatctcacttatatgtggagtctaaaaaagttgaa

SEQ ID NO: 30353 - DNA, 328 bp, Homo sapiens
gggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagat

SEQ ID NO: 30354 - DNA, 412 bp, Homo sapiens
  misc_feature 33: n = A,T,C or G
atctcagtctcctctggaaaacaggctcacagnacacacacagcaacaatgcttcagcagccatgtaggcatgcctgagtccagtcaagttgacacctaatattggccatcacgatatgtgaccttctgtctggcttctttcacttagcatcatgtttttgagattcatccacatgtattagtgtctcattcttttttatggctaaataatattctattatatatacattatacagatatggatatacacattttgtttatccattcatctaatgatagccgtttggattgtcccatcttctggctattgtgaatgatactatcattaacattcgtgaacaaattttttttgagaacctgttttcaattattttggggtatattacacctaggagtggaattactggatcat

SEQ ID NO: 30355 - DNA, 467 bp, Homo sapiens
  misc_feature 5, 15, 19, 24, 28: n = A,T,C or G
ggaanaggtcctggngctntgcantgcngaaggggaaccagggcaaatcttatgtaaagatttttcagcaacttgtcccaatttgtgtgtattctgaaactttctctttgggaccaaattcattctcaatggccctgagttcaatatattattaacagcggtattttaaaacttagggttgaactgggcatggtggcacataactgcaatcccagctactttggaggcagggatgggaggatcacttgaggccgggatctcaggaccagcctagagagatcccatctctaaaaaataaaatataagaaaataaaacttaggggatatacagatttaaatattcaaatctccctgctcccctgaaagtccccaggcagctgttaatgacttgtttgttgtgttctcaatatgatggctatttgaaacttcacctacttttcattagattggttgtaccatgtcacctt

SEQ ID NO: 30356 - DNA, 259 bp, Homo sapiens
  misc_feature 24: n = A,T,C or G
cagtggtggaagaacggtctcagnaactgtttgtttcaattggccatttaagtttagtagtaaaagactggttaatgataacaatgcatcgtaaaaccttcagaaggaaaggagaatgttttgtggaccaccttggttttcttttttgcgtgtggcagttttaagttattagtttttaaaatcagtactttttaatggaaacaacttgaccaaaaatttgtcacagaattttgagacccattaaaaaagttaaatgagc

SEQ ID NO: 30357 - DNA, 127 bp, Homo sapiens
gggtggggggcactgtacccttctagccccatcaggggccctgtagacgtcgctattttggtacgattcctgtcatccctattgcagagtcgtgtccccaataaacaggtgtcttgaggaaaaaaaa

SEQ ID NO: 30358 - DNA, 306 bp, Homo sapiens
  misc_feature 279, 291: n = A,T,C or G
ggtgatggagtatcttgcctttgtgatgagtgctacattacagaaatggagatgctgctgaatgagaaaggggaattcacaattgaaactgaagggaaaacatttcagctaacaaaagacatgatcaatgtgaagagattccagaaaacactatatgtggaagaagttgttccgaatgtaattgaaccttccttcggcctgggtaggatcatgtatacgggatttgaacatacattccatgtacgagaaggagatgaacagagaacattcttcagggtnccctgctgaagnggctccattcaaatg

SEQ ID NO: 30359 - DNA, 471 bp, Homo sapiens
gaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatagcctctcttgctacagaaagatactaaaagatcacaactgtcacaaccttccggaaggagtagctgacctgacacggattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaaca

SEQ ID NO: 30360 - DNA, 104 bp, Homo sapiens
cacccgggaattcggcattatggccggggaacaaggcaggccgccagccaatcctagaagctttctggtttgggaaggctgcaaattgtaagctgggtgttggg

SEQ ID NO: 30361 - DNA, 363 bp, Homo sapiens
ggagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcac

SEQ ID NO: 30362 - DNA, 189 bp, Homo sapiens
gaccattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 30363 - DNA, 195 bp, Homo sapiens
caagataattttgaagaaggcctaagaagatgggttgaatggccagatattaagacttaatgttgatgcggtgtggtgactcacccctataaatcctagcgcttttgggaggccaaggcaggaggatggcttgagctcaggagtttgggaccagccctggcaacatggtgagaccctgtctctacaaaaaaaaaa

SEQ ID NO: 30364 - DNA, 346 bp, Homo sapiens
ggcgaatggcaggtcccgagtcgcagcttccgctggcgcgggttgagtcccctgttgcccttggtctcggggtcgctgtcggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaattcga

SEQ ID NO: 30365 - DNA, 476 bp, Homo sapiens
ggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgaca

SEQ ID NO: 30366 - DNA, 441 bp, Homo sapiens
  misc_feature 6, 22, 405: n = A,T,C or G
tcggcntttatggcccggggcnaggggagtgggaaaagtgggcttgtgctgctgcctagacagtagggatgtaaaggcctgggagctagaccctccccaagccccatccatgcacattacttagctaacaattagggagactcgtaaggccaggccctgtgctgggcacatagctgtgatcacagcagacagggtcgctgccctgatggcgcttacattccagtgggtctaatgaccatatcttaggacacagatgtgcccagggaggtggtgtcactgcacaggaagtatgaggactttagtgtcctgagttcaaatcctgattcaggaactcacaaagctatgtgaccttacaccagtcacttaacttgttagccatccattatcgcatctgcaaaatggggnattaagaatagaatcttgggggttaagtgggggaga

SEQ ID NO: 30367 - DNA, 368 bp, Homo sapiens
atcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtcctttcccccttacttggtttttggtggaagcctggtggttttttgtgaagctcaagctcctaatgatagccattgagtacaagtctgccacccgagagagccggatttt

SEQ ID NO: 30368 - DNA, 471 bp, Homo sapiens
gactctggaaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagag

SEQ ID NO: 30369 - DNA, 450 bp, Homo sapiens
  misc_feature 39: n = A,T,C or G
ggagcattagtaagggtcaaaactgtgactgactaaatnatattatagatttctctatgtcattatgtccataggtccatgatgatactaaaacaaactaactggccactactgtccatttttaggcaagaatcaaacataaattctgcttttcctataccaattgccaaccacatagcagacaagtaaaagtttctctttatagatatattccaactaataaaagaaaaaggcatgctagaattacagtatcaccatattgcagtctctaatgaaataatggatctaggttaagcattaacacagccaataaatcacacacaaaaagagagatactagatcctagatgtgcttcctgatggaagaacacatcaccacctgtgaagcagtcttgcagcctcaaaacatcagttcttattctgatcaagcttctagctttaacaacaagct

SEQ ID NO: 30370 - DNA, 498 bp, Homo sapiens
  misc_feature 5, 19, 27, 78, 79, 129, 140, 169, 198, 232, 256, 268, 308,326, 347, 355, 461: n = A,T,C or G
acaanatctagggacacancaaaaccnctgacagatggcaaggctcggcgattctgatttcccttctcaaatctgctnnactccaacagtcttgagaaactgctaaaattttgcctctgtcactcaagncttacaaatgntatcttgtaaacctttgaggtgaactatnccactggctcgtgcataggcatcttattnactgcgccctgtcacacccagcaccccccgcccngcacattatttgaaagactgggantttaatggttanggacagtaaatctacttctttttccagggacgactgtccnctctaaagttaaagtcantacaagataactgtctatttntagcctanagtaaaggctgtgaagaaaattcattttacattgggtagacagtaaaaaaacaagtaaaataacttgacatgagcacctttagatcccttcccctccatgggcttngggccacagaatgaacctttgaggcctgtaaagtgga

SEQ ID NO: 30371 - DNA, 310 bp, Homo sapiens
atggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtac

SEQ ID NO: 30372 - DNA, 121 bp, Homo sapiens
  misc_feature 2, 28, 30, 31: n = A,T,C or G
gngggaaatcaagggttcgattccggananngagccctgagtaaacggctacccacatccaaggaaggcagcaggcgcgcaaattaccccactccccgacccggggaggtagtgaccaaaa

SEQ ID NO: 30373 - DNA, 128 bp, Homo sapiens
  misc_feature 20: n = A,T,C or G
ggctctgatttacaattatnagaaggtcagttttaaaaatcttgttacacctggggagcaaacaacaaggtataacccaggtataaactcttaggatacatccaaaggtgtcaagagttacaacaaaa

SEQ ID NO: 30374 - DNA, 476 bp, Homo sapiens
gcattctacaactcaaaaagtttaaggcaccccacaactcaaaaaagttcatgggaatttaaaataaaatggaaagtaaacaacatttccttatatagcagccctggtgggtatggcaggagacattcaccaagatacatatgtaacacaaaccttataaactttttaaaaagagatatcatatagcatatgttcttagaccacaatggaattaaaatataaaccaatagaaagatatttgaaaaatcctcaaacaattggattttaaaccatacacttctaagtaacccaaaggtcaaagagtaagtctcaaaggaaattaactaaatgaagatgaaaccgtattaaaatttgtggaatgcagctaaggcagtgcttacagggaaactttatgttaaatatttatattataaaaggaagaaacatcttgattcagtaacctaagcttccacattaagggcctaaagagaaaaaaa

SEQ ID NO: 30375 - DNA, 472 bp, Homo sapiens
ggagcccggaggggacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttg

SEQ ID NO: 30376 - DNA, 476 bp, Homo sapiens
gttggagcctgctctttgaactccgctgcgctcctcagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgtcctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgc

SEQ ID NO: 30377 - DNA, 286 bp, Homo sapiens
  misc_feature 35, 191, 193, 232, 270, 276: n = A,T,C or G
cagtggacaaaatatgactcactctgtaaataatnacttgaaacgtgataaactgtattttctaccccatattttacagaaaaatgtatcacaggtggatcaaagatttcaatataaaacttaagtctgcaaggtactcaatgtatgattttttttttttaatcttaggatagggaaaacctttgccagtntnccccaaacccataattttatagcttcttttaaactaatncattggcagggcttgggggcttatgcctgtaatcttancagttngggaggctaa

SEQ ID NO: 30378 - DNA, 125 bp, Homo sapiens
cattatagaattactcatcttctcagacacccactttcctcatctataaaatggggatcacaggattttttaaatgcctagcacatggtggatgctctataaattatctggcttttttgtttttt

SEQ ID NO: 30379 - DNA, 379 bp, Homo sapiens
  misc_feature 17: n = A,T,C or G
agatcagaaactttgcngcgaggactgcctaggaatgctggttagccatgtgaaacattctataccccccttggggggttttaaaggccagtgagaggttaaaataaaagctcagtgagtggcccatgagagcccattgctggggacactctttaccagatgggcccataaatataaaaagcagatgctcctgccttctgcacaccttgtccaccccctggagtaaattattccagtggttttcctacagaacaacccaagacaaccggaatggcctgaggaactggctctgccctccagaactaggcgagttcagtgcacagtgagctgtctctcagtccagacacaggggcccctgaccgccagccttcaactccaa

SEQ ID NO: 30380 - DNA, 336 bp, Homo sapiens
  misc_feature 21: n = A,T,C or G
gggttcgtttttcctttagtnggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattac

SEQ ID NO: 30381 - DNA, 333 bp, Homo sapiens
gtggttacctcagctatataactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatct

SEQ ID NO: 30382 - DNA, 482 bp, Homo sapiens
  misc_feature 19: n = A,T,C or G
ttatggccgggatcccagnaatgggaaggtagagccccagactctgtcgactatcgaaagaaaggatatgttactcctgtcaaaaatcagggtcagtgtggttcctgatgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgta

SEQ ID NO: 30383 - DNA, 311 bp, Homo sapiens
aagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaa

SEQ ID NO: 30384 - DNA, 392 bp, Homo sapiens
tgcaggacttgcccccccagttcctatgacacagttatcaaaaagtattatcattgctcccctgatagaagattgttggtgaattttcaaggccttcagtttatttccactattttcaaagaaaatagattaggtttgcgggggtctgagtctatgtccaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgt

SEQ ID NO: 30385 - DNA, 470 bp, Homo sapiens
ctttcggccggacccgcctcttccgtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatg

SEQ ID NO: 30386 - DNA, 449 bp, Homo sapiens
gtggttttggtgactaaaaatgaggattggatgaccattgactaaaaatatatatttatatgtattttatatatatcaacatatacatatatatgatatattcaggtttttaaaagtaaatgataaagaacatcactaattttattttatttttagtaaatcagtaaatcaaatatgtaccagtttttaaattctggaaacaaagattccaggtttctatagcgtttaacaaattattattcatagcaaaatctgcattcctgaggctgggaactagaggaaagggtttgtgtctaataggaaccaattgaattttagaaaggatgttaacatatagctgttttactgtctataatgttaaatgaatacacttttggcctctgtctagaaaaaaataacatcttaatctagtgtgtgattcttatacataagactttttaggggatgac

SEQ ID NO: 30387 - DNA, 141 bp, Homo sapiens
  misc_feature 4, 13: n = A,T,C or G
agcnatatcaacnttaaccttccctctaacttatcatcttcacaattctaattctactgactatcctagaaatcgctgtcgccttaatccaagcctacgttttcacacttctagtaagcctctacctgcacgacaacacca

SEQ ID NO: 30388 - DNA, 473 bp, Homo sapiens
  misc_feature 18: n = A,T,C or G
acagcaagacgagaagancctatggagctttaatttattaatgcaaacagtacctaacaaacccacaggtcctaaactaccaaacttgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtgatccaggtcggtttctatctacttcaaattcctccctgtacgaaaggacaagagaaataaggcctacttcacaaagcgccttcccccgtaaatgata

SEQ ID NO: 30389 - DNA, 476 bp, Homo sapiens
gaaaagaaaaaggcaggggactggacctggaggagtgcctgcatttaatggctggggaaagaagaacgagcctgctaacgttttccaagaagcagccctgagaaggagataagaaaaagatcagtagctggaggagggcatgggttcaggtttttaatttttttattggagaggcatgaacatgtttaaaagttgacagccagctgctatggaaaatagtttggtggttcctcaaaaaattaaacataaattaccagaagacccaggaattttacttctaggtatccacccaaaagaattgaaaataaggattcgaacaaaagtagcactgttcacagtagccaaaagacagaaacaacccaaatgtcctttagctgatgagcaaataaaatgtggtatatccatacaatgaatagtattcagtcataaaaaatgaatgaaagtgggcttgggtgcagtggctcatgcctgtaatc

SEQ ID NO: 30390 - DNA, 472 bp, Homo sapiens
ggaccctccaaggaaggtgtgggatataatctcctggtgcaccgtttttacagcccgtccgaaaagcacagtattatggtgggagtgacccgattttccaggtgccgtctgccacccatttctttgactaggaaagggaactccctgacctcttgcacttcccaagtgaggcaatgcttcatcctgcttcggctcacgcatggtgcacttgcacccactgtcccttgcccactgtctggcactccctagtgagatgaacctggtacctcagatggaaatgcagaaatcacctgtcttctgtgtcgctcacgctgtgagctgtagaccagagctgttcgtcttcggccatcttggctcaggaatcttaaagtcttaaattctaaaaaaaatctgaaaactccgaacaaaaaccctaaaaaacaagaaaaacaattaaaacccaaataaagaaagaaagcatggataataaaaa

SEQ ID NO: 30391 - DNA, 384 bp, Homo sapiens
caagaaaggagggtatcccacctgaccgcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagc

SEQ ID NO: 30392 - DNA, 471 bp, Homo sapiens
  misc_feature 457: n = A,T,C or G
atctctggcgagtcctgaaggatgagtaaaaaatctatgggaaaaggaaactgggaaacttatttcagaaatagcctgcacaaaagcctggaagtgaaaagagagcagtatatggatatattgagagtgaaagagtagcaagagatcaggcaggggcttgtataacatgctcatgttacacatagggccttgtataacatgctcagaagtttaggctttgaagctaatctttcactgggcttccctcactgatagccatattttggtttggtcaatcaaaaatctataaagcctaagtaataagtttggtaaggtgtcaaattgtttaaacataactttattcttcctaatagtcatgatacaaacaaattactatctttaaactataatggcaaaacttattcttgacattctgtatgaaatgctattaaacatttacattctagttagagatttnaaagtgactcttgg

SEQ ID NO: 30393 - DNA, 473 bp, Homo sapiens
cattgagatatctgctccagaaccaaccggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataag

SEQ ID NO: 30394 - DNA, 473 bp, Homo sapiens
gggatgaaactgagaacaaaggcagcaaacgttcctcaaatggtttacagaattccttcaagcaaatcaacatgatgttgctaagttttggagtgatatttcagaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcaga

SEQ ID NO: 30395 - DNA, 478 bp, Homo sapiens
  misc_feature 19, 24, 27, 34, 145, 162: n = A,T,C or G
catatgcgccctatagtgngttgnatngggcagnaacattaaaatataaaattaatagtaagacatatctgaatttttgttctagaaggtcccagagctctcctttaccattctacctcagagagcccttttccttctgcatgtnatcttgggactgtccanggctctatgcctgcagggcctagagccagtccatgaagtgctcattgagtgctttgtggtctaatattctacccttcctgcaagcttacaaatcaaccccttcaagactgataaagacagagcagaggttctttagtatctagagtccccagaagtcaggaaggttgtgaacttggatgggtaaaaaaaatatctgttttgagatgaagtcttgctctgtctcccaggctggagtgcagtggcacgatctcggctcactgcaacctccacctcctgtgtccaagcgattctcctgcctcagctactccagagattg

SEQ ID NO: 30396 - DNA, 266 bp, Homo sapiens
  misc_feature 45: n = A,T,C or G
gcacccagcctacttcactcttctgaattattctgatttattttnaacaacttttgtgaacttgcccgtgatacaaagcagatagtccctgaaccacagtcgtgcctccttgaaacaagccattctactgtgctaatgttttaatatcacatctcacaaataacaggggtgaatgtttctctctagcaatctaggcaggtgctggtgtttcatctccatttgaatgcttgacctcttaatgtgtgtgtgtgtgtgtgtgtgtgtgt

SEQ ID NO: 30397 - DNA, 109 bp, Homo sapiens
gaaaaaatcctcagaagaacaaattgctaagctacagaagcttcatgaaaaggagctggccagaaaagagcaggaactgaccaagaagcttcagacccaaaaaaaaaaa

SEQ ID NO: 30398 - DNA, 467 bp, Homo sapiens
  misc_feature 38: n = A,T,C or G
atgattttgaaggctgtgggttcagggagtctttgccnatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagcctcggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgt

SEQ ID NO: 30399 - DNA, 296 bp, Homo sapiens
  misc_feature 147, 163, 196, 217, 243, 275, 280, 287: n = A,T,C or G
aggcactggaaaccggcattggcgtcattcttttcctccagcatggagtgcaacccttcacccactctgccccaaccaccccagtcccacctactacagcatctcctgtcatccctggtgagcctatgaaactatctggagaggggncctcggttgctacagnttgccagtaactctgccatcagactgggagctntacccttttccccttccagtntaacccaccttggcccgaaagatgancctttggaaccccgggggccccccaaaaaaanccctnccccccnggggggggg

SEQ ID NO: 30400 - DNA, 209 bp, Homo sapiens
  misc_feature 15: n = A,T,C or G
agggtttcaatttcncacatgatctctgcaaacaggcactgggttttcagtgtcctttttgaagggtcatataaaaataaggtaacaccacagtgccactacaccttctggggctggacttgtttcagcagctttggttgcactgaatttgggggagctgcatggtaccaggggtttattgggttgcagatatataaatgccctaaact

SEQ ID NO: 30401 - DNA, 431 bp, Homo sapiens
ctccaaaaaatgtttgaagatgtatctaacttttgtgtgtgtgtcattttacttgttcctgtgtcccttgtattactaaaagttaggtcagaaccctaagttacattcaggtttaaacatttttggcaagaatacttcataagtagtgttctatactttatattgcatcacttcaagagtatctggttgttccatgttttgtaattgattactctgttaaggaaaagacaagcagaccaagtatggtggctcatgcctataattccaacattttggaaggcccaggcaggaaaatttcctgagcccagaccagcctaggcaatatagtgagactccgtctctacaaaaaatgtttttttttgtttgtttgtttttaattagcttgggggtagtggcacatgccttgtaatcccagctacctgggacattga

SEQ ID NO: 30402 - DNA, 425 bp, Homo sapiens
  misc_feature 318, 333, 376, 425: n = A,T,C or G
aaggaaagatacaaagttctcgagcgacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataatttttttttttaatatctggagaacattaataacaagttaaattattctttagnggtcattttttaagngcacaattaataagaagcacaacttgttcacaagctcattcanaaatgattctcccaacaatgcatatcagctattcattgatacttagagn

SEQ ID NO: 30403 - DNA, 139 bp, Homo sapiens
aaatgcctcgtaatctaattagtgacgcgcatgaatggatgaaacgagattcccactgtacctatcctacttccccttcctaattccacagctgctcaataaagtacaagagcttaaaaaaaaaaaaaaaaaaaaaaaa

SEQ ID NO: 30404 - DNA, 111 bp, Homo sapiens
ggggaatcagggttcgattccggaaaggagcctgagaaacggctaccacatccaaggaaggcagcaggcgcgcaaattacccactcccgacccggggaggtagtgacaaaa

SEQ ID NO: 30405 - DNA, 275 bp, Homo sapiens
  misc_feature 252: n = A,T,C or G
actgtgtgcacagtctgcatgaaaattgcgtagacttcagtgtgggaaaattaggtgctgaactgactgattctttgttgaggaggatggtctcaacatcattatggagaggccaggtgtggtggctcatgcctgtaatcccaacactttgggaagctaatgcaggaggatcccttgaggctgggagtttgagaccagcctgggcaacactggagacttcgtctctacaaaaaaaaaaatgtttttaactanccagtcatgttgagcacatactg

SEQ ID NO: 30406 - DNA, 265 bp, Homo sapiens
attaacaattatgagaatcataagaaaacaagacactatcaaacataaggagggatggggggaacagaacttacagaaatttaaaaatcatcaaagtggataacttattcagcaaattagaaataggtggattggaaggtgaatttgaataaatcactcaggatgcgcagagaaaaagagatggaaatatgaaagaggtcaagagacaagaagaataaaatgagaaggtttaacatatgtttgaaaagagttcctgaaaaaaaaa

SEQ ID NO: 30407 - DNA, 458 bp, Homo sapiens
aggcgttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagaga

SEQ ID NO: 30408 - DNA, 458 bp, Homo sapiens
ggaacatttcatttgtgttatttcttaaacttctatttaggaaattacattaagtattaatgaggggaaaggaaatgagctctacgaggatttcaccctgcatgggggagagcagggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagaagaaa

SEQ ID NO: 30409 - DNA, 254 bp, Homo sapiens
ggcttctgagataacctggctgcgggaagcagaggttgtcgtgagcagagattgtgccattgcactccagcctgggcaacaacagcgagactccatctcaaaaaaaaagaaaaagaaaaaaggaaaaaaaagaggccgggcgcagtggctcattcctgtaatcccagcagtttgggaggctgaggcgggcggatcacgaggtcaggagttcaagaccagtctggccaacatggtgaaacccccgtctctactta

SEQ ID NO: 30410 - DNA, 131 bp, Homo sapiens
  misc_feature 18: n = A,T,C or G
cacccagggaattcggcnttatggccgaggtgtgtgtataactataacaattagaatatcataacactgttaatagaccataaagtgacaaactaccccaaaacaaatcccattttcacataaaaaaaaaa

SEQ ID NO: 30411 - DNA, 248 bp, Homo sapiens
ggctgtagtggcttcgtcttcggtttttctcttccttcgctaacgcctcccgactctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaaaaaaa

SEQ ID NO: 30412 - DNA, 231 bp, Homo sapiens
ttcctggctctggcccagaaagtgattcatttgtaaattatcatggttttctttctgcattaaaatgctcatttccggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 30413 - DNA, 476 bp, Homo sapiens
gagactgtagaatattattgggccagacaaggtgttttggcagagctgcccttttgcccttaaacaagttacaggcacagctaaaaatccctagctggttgtaaaatatggtaacctatacaaaatgcagcctcgagttcatgagccatttatcaaacttttttctcaaccatttgtgctgggcatccaatttttttttaaactttagattatctagctccatttgctcattttggaaatattctataatttaaagttgaactgacaacttattcattgtctcaagaagtacccttaacacctttaaaaattgtttgcttgaactcaaatagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtac

SEQ ID NO: 30414 - DNA, 473 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcgtgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtga

SEQ ID NO: 30415 - DNA, 483 bp, Homo sapiens
  misc_feature 15: n = A,T,C or G
agctatattaatatngacagaacaaacttcgagaaaggaaaattataatggattaaaaggaacattacatgatgataaaagggttaattatccaagaagtcttagtaatatttaatatatatgggcctaaaaagagaggcccatatattaaaatgtgtgaggtaaaacctgatggaactttaaggagaaatagacgaatccgccattatagttggagacttcaacaccttgctatcagaaatggagagatccagcaggtagaaaatcagtaaggacatagttcaactcaatagcaccataaataaactagatataattgacatctataggctacttcatccaatgacagcaaaatacacattttttcttcttcagcttacacagaacattcataagatagaccacgttctaggtcataaaaaacacctcaaaaatttaacagaatacaaatcatagaaagcatgttctcagaccacaatggaa

SEQ ID NO: 30416 - DNA, 169 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttacaaaaaaaaaa

SEQ ID NO: 30417 - DNA, 395 bp, Homo sapiens
atagattgtcaaaaaatactttgggaaactgattataatatcaaataattcagtgctgctgtctcttacacttttatccctatctgtaaaacaaactacaaattgagagagtacattccatagcttgggaaaaaacccaattgtgttgtacctaaactaatcatcttaaggcagtagttcagaagaacagtactactataagcctcagaaagaggaaactacctgggtatggcgggtgggagcggagagaggatccgaaaaaaatacctatcgagttctatgcttattactggggtgatgaaattatctgtacaacaaatctctgtgacatgcactttatatataatacaaacctgcacaaaaacctaaaataaaagttaaaaaaaatgacaact

SEQ ID NO: 30418 - DNA, 273 bp, Homo sapiens
tgcagtggctcacgcctgtaatcccagcactttgggaggtagaagcaggcggatcacaaggtcaggagatcaagaccatcctggccaacacagtgaaaccccgtctctaccaaaacacaaaaaattagccaggcatggtggcgcacacccgcagtcccaactactcaggaggctgaggcaggggaatcgcctgaacccaagaggcggaggttgcagtgagccaagatcatgccactatactccagcctggcaacagagcgagactcaatctca

SEQ ID NO: 30419 - DNA, 473 bp, Homo sapiens
actataattataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccagtgggtacgatctgtatcttttagccatgatggactgcatgttgcaagccttgctgatgataaaatggtgaggttctggagaattgatgaaggattatccagtgcaagttgcacctttgagcaatggtcttt

SEQ ID NO: 30420 - DNA, 471 bp, Homo sapiens
acaggagtttgagaccgcctgggcaacaaaatgagattccatctctacaaaaaaaatacaaaaaactggctgggcaccgtggctcacgcctgaagtcccaaagtgctgggattataggcacgagccacctcgcccggcctgacaaatagttttttaaatcagtaaaactgtgtttatgattttgataaatatgccttctattaaataacaaggcagaattgctaagtttcctaactaaaatgacccctgataatcagtttttttcagccatagatcttcattcactggtcttttcaaaaataaatgatgatttttaaaaatcaggtttctgaactacgctagtttgcatggtcttttgttttccagaaactgccaaaatccttctattgtgtttattttcaaataattgtctctaaaattctagaaatattccctttaaaaaagaaaatttgaaagaatgaacaagtaagc

SEQ ID NO: 30421 - DNA, 220 bp, Homo sapiens
caaattacatttcatggtttcccattgtttcacaatgagttctaataaatgggatttactataataatccaagtatgacatagccggtatgctttcatgaatgtttttatgtagattttcctcccatgaacatgagtaaataaatctgtttcctgaatggattgtggttgcatttaaagctctgtaataattctaataaatttactctataggaaaaaaa

SEQ ID NO: 30422 - DNA, 476 bp, Homo sapiens
  misc_feature 11: n = A,T,C or G
ggcattcgganggaagctgacatccacaccaagtcgagacttccagggatgtggccggggagcagtcacatgctgtagctttcatgagcacaggcatcagtcaggcagatgtttgtcgactggaatggcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactatgtttcaagctgctcaaa

SEQ ID NO: 30423 - DNA, 383 bp, Homo sapiens
  misc_feature 9: n = A,T,C or G
cggccaagnaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatc

SEQ ID NO: 30424 - DNA, 136 bp, Homo sapiens
caagtcgagtacttccgggatgtggccggggagcagtcacatgctgtagctttcatgagcacaggcatcagtcaggcagatgtttgtcgactggaatggcgccaaatcttaaaggcagaccacgcaaaaaaaaaaa

SEQ ID NO: 30425 - DNA, 405 bp, Homo sapiens
aatgaatgggaattgcaaatcaactggattttcattatttccttttaatttatatatggagaaatgtgaagagggaaaggaaatggaaagagaaagagaaagggagataaaaatagtgaaaataagagcctccaggctcagaagaactgattacattcttaaggtgaacaggaaaaatacaatctataactttctttgatgaggaaaaattaagtttacatttttcatatttagtgttaaacaatttaatgtagattaaaataaaagaccagtattaggaggaaaaaacaagtgcctaaatgtcttaatgctctctatgtgagacagaaatagacgtgaccattagtaatgcaactatttttgtcaaatttagtgggattttttgggttgttgtttgttttcttg

SEQ ID NO: 30426 - DNA, 338 bp, Homo sapiens
cagaacatttttagtacctagttttattaaatattacacttgagagacactttttaaaaatgtgttaatgtcaatatgatgagattttagcctttctccagaactaaggcattaaagaaaatagcaaatattaaaaaataaaactgttacttttttccttctttcttttcacctttaggttaatatccagtattatgtgttatccctttggataagtatgctttattttacctctgttaaaaattaaaataaatgattctattcatatttgtcagtaattcaaaacttatatgtgtaactgaacgcgcatgtaaggtatggttttatttatttatttt

SEQ ID NO: 30427 - DNA, 477 bp, Homo sapiens
gaggcattgaggcagccagcgcaggggcttctgctgagggggcaggcggagcttgaggaaaccgcagataagtttttttctctttgaaagatagagattaatacaactacttaaaaaacatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaa

SEQ ID NO: 30428 - DNA, 433 bp, Homo sapiens
ggcgttccctgtgcgccggcagtgatcccctgcgtggctgggctgctcgggttagatcgtcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttat

SEQ ID NO: 30429 - DNA, 308 bp, Homo sapiens
cgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaagc

SEQ ID NO: 30430 - DNA, 473 bp, Homo sapiens
atcccaggacctatatagtgagcaaattattgtctataatatcagactgagaattatctgaaagtgaggctatacatcataaatacttttataacctaaatattaagatacttagtaattgcagttgattatgtctagaatgttggactgattcatataagaaatctattaagaacttaagcagatggatgaaaataagtgaccagtctatttttaatccatattataccaatagattcatgtagatttcttatatatgccccattaacttttacaaaagaaggaagagtaagtgaaggaatcaaaatacatgggatgaattgtcatttttgataatttcatatatgccttgaatttagagaacctagaattcagtcttcccaagtcacttttttacttccttaatatgtaggctaggaaatctctcgtaataaaatgctgttgaatacaatgaaaccataaagaatacccaa

SEQ ID NO: 30431 - DNA, 470 bp, Homo sapiens
  misc_feature 446: n = A,T,C or G
gctctttttccggctggaacctggagggtgtagaagagaagaagaagggggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggatttgtagagccatatattgattnggggggtaccccaatctgaagtca

SEQ ID NO: 30432 - DNA, 325 bp, Homo sapiens
  misc_feature 18: n = A,T,C or G
atctgttttatttttttncgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaa

SEQ ID NO: 30433 - DNA, 224 bp, Homo sapiens
  misc_feature 34, 93, 124, 201, 221, 223: n = A,T,C or G
cagaaagggaacgtataattaacctgctgcaggnagccatggagtctctgggatatttatgaaatatgatctcagttctcttatggtgacagntactgaggagcacatgccattctggccgtcntttgtaagactctgtggtattgttggaggaatcttttcaacaacaggcctgttacatggaattggaaaatttatagntgaaataatttgctgccggntna

SEQ ID NO: 30434 - DNA, 473 bp, Homo sapiens
  misc_feature 10, 24, 81, 96, 128, 150, 262, 268, 306, 319, 331, 389, 390,399: n = A,T,C or G
ggtatgaatntgtgacggtggctngaggaggaacctgtctttaaagctgtccctgaagtgacagcggaagagaaccaggcngcccagaaaccccangcgtggagattgatcctgcgagagaagggggntcatcactggcggatgacctanagcgattcttgtataaaaagttaccaagtgttgaagggctccatgccattgttgagtcagatagagatggagtacctgttattaaagtggcaaatgacaatgctccagagcntgcttngcgacctggcttcttatccacttttgcccttgcaacanaccacggaagcanacttggactttncaaaaataaaagtatcatctgttactataacacctaccaggtggttcaatttaatcgnntacctttgntggtgagtttcatagccagcagcagtgccaatacaggactaattgtcagcctagaaaaggaacttgctccattg

SEQ ID NO: 30435 - DNA, 500 bp, Homo sapiens
  misc_feature 4, 13, 33, 62, 455, 461, 475: n = A,T,C or G
agcnttgggaaanagttaacatcttggttgaangacctaccctgactaggctgtgtagcacnaagtcttgcttaaaaagccccctccatttcagttacctgtgttttttacctttatccctataatttcttttatcatacctcccacataaataaagagaagataatacatatgtaatatttctatcttgaaagatgctggaaaagatttttttcttccaatttagggggcatactaacaattttgacaacacaagaacatctagccctgttactgtggcgcacaccctagcagtttgggaggccgaggcaggaggattgcttgaggccaggagttcgagaccagcctgggcaacatagtgagatccatctctacaaaaaatttaaacattagctggggtgtgggtagcatgcgccttgtggtcccagctacttgggaggctgaatggggaaagnattacnttgaaccccaagangtcaagactgcagtgagccatgctt

SEQ ID NO: 30436 - DNA, 422 bp, Homo sapiens
  misc_feature 8, 16: n = A,T,C or G
atttgagngccagccnagccgccagggggcctttctgctgaggggggccaggccggagccttgaggaaacccgcagataagtttttttctctttgaaagatagagattaatacaactaccttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagttttagttaaa

SEQ ID NO: 30437 - DNA, 307 bp, Homo sapiens
  misc_feature 4: n = A,T,C or G
tacnagcatagtgactctagttaataatactgacttgcatccattaaatttacgcagagagtaagatctgaagtattctcagcacacacacatactcacacacatgcacaatggtaactatatgaggtgatggatatgttaataatcttgaccgtggtaatgtgtatttgataaccatcacattgtacatattaaatgtgtaaaattattgtcagttttacctcaataaaaccaggaaaaaatactgaaaactactccaaaacacaaagtaaaatataataataataaataacaatcaattccacca

SEQ ID NO: 30438 - DNA, 473 bp, Homo sapiens
  misc_feature 12: n = A,T,C or G
ggcagcgctttnacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaa

SEQ ID NO: 30439 - DNA, 241 bp, Homo sapiens
  misc_feature 15, 103, 116, 167: n = A,T,C or G
tgtaaatcccccaancactttttggaaagggcttgaagggcaggccaagaattggctttgaagggtcaagggaaattccgaagaacccagcccctggcccaancattggccagaanccccttttcttcccacttaaaaaaataccaaaaaattagtcaagggtgttngggtgggcaccgccaagcttggtaattcttcagcttacctcttggaaggcttgaaacttgggagaaatcacttt

SEQ ID NO: 30440 - DNA, 200 bp, Homo sapiens
  misc_feature 152, 177, 192, 197: n = A,T,C or G
aaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccncaatcatttgaagaaatgtttaatnaaatctactttgagnctctnaaa

SEQ ID NO: 30441 - DNA, 327 bp, Homo sapiens
  misc_feature 9, 23, 29, 36, 51, 63: n = A,T,C or G
aggatgggnggattcttagctgnggtggnctcgggnagcagtataaacagnacaacccacagngtgggagaaaatcttcacaatctatacatctgacaaaagactaatttccagaatctacaaagaacacaaacaaatcagcaagaaaaacacaagcaaccatatcaaaaagtgggctgaggacgtgaatagacaattctcaaaagaagatacacaaatggccaacaagcacatggaaaaatgtgcaatatcactaatagggaaatccatatcaaaaccacaatgtgataccaccttattcctggaagaatggccataatcaaaaaa

SEQ ID NO: 30442 - DNA, 498 bp, Homo sapiens
  misc_feature 15, 16, 47, 61, 87: n = A,T,C or G
ccgggaatttcggcnntttttggccgggagtggaagtcctgcaggancccaacctctgagnactgaatgctacttactatattaccnaagcaaatccttccccccttggcaagaatcttctcacttattggtattgatgtcttcagctggtatcatgaattaccaaggatccataaagctacccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaaggtacagttttgttccatgggcccagaatcacaagcagtctgatcttacaggaagatatagtcactcttgaactatagtgtgagatacaaaactggtgtgaaaagtgaaatggaagagtc

SEQ ID NO: 30443 - DNA, 372 bp, Homo sapiens
  misc_feature 8, 16, 22, 23, 37, 38, 40, 48, 49, 61, 63, 110: n = A,T,C or G
ggggtccntgggtcantttttnnctccctctctagannantacccctnntgttttcttgcntncactgggtgggtggaaataaagagggaaaataccctaaccaaataantattctattaatattgggatgaaacccaaatattatataatgtatcatggctctacagagaaagaagacttttagcaagtgaggaattactactctctgaaaagaaaattaagaaaagataaaatcaacactgaggagattttataagaaatctttttgagatatttttccagtatacaaattttgcgaagcatgaagttttacggacctgttccgtttgcattttaaaccccctgagaagaaaatcagaagctgtgaagaa

SEQ ID NO: 30444 - DNA, 484 bp, Homo sapiens
attgctactattacttataatagaacacttgatactgaacagtatctttggatactgacatagggtgatcattattgaattatttaaacattcatctgcttaaagattagatgctttcttacgcaatttttcaacataccttccagttcattttatcactctgttactttagaggaagcactgtggtcattagttcttactctatcaaaatgatatttaactctcagatacctcagtcagagcctgatccttactataattgaaataaaaattattgagcctcttctgtattttatactagagaccttgccctgcattgccagggaaaatcattaaccactgcaaaatttaaaaatccctattgctgctcatcttggagcatcctgtgctccataagtatacacacaatttcttgtgataaagtaccagaaatgtcattttacttatttagatgtactgtactattgccaacctacctagagat

SEQ ID NO: 30445 - DNA, 448 bp, Homo sapiens
  misc_feature 15, 35, 38: n = A,T,C or G
tttatggcccgggantgtctaattttaggaaaganatnatcacccaaaattctgaggaaaaatgaaatgtgctctggtttaaatagttttcttatttttctttttatctagattctcagatgttggttgtttctatgaaaccaggcaggaaattgaatgcattatgtttttaaaactttaaacctgcttctgttctgtttgactggcatttactattttctgcatttcattctctcacctaatctcttcctttctaatctgcttactaaaaatgaagatttaacatcagaagccgggctcagtaactgatcaaagggaactttaagatgcagtcttgtggcgcagtttgggctgctaacctactatctaaaggtgatgcttcaaatggcttttctgtgcatgtcatggattttgtgaatgggtgaaaactgtctctaaactgtgtggt

SEQ ID NO: 30446 - DNA, 385 bp, Homo sapiens
  misc_feature 4, 5, 127, 153: n = A,T,C or G
tganntgcttgttccgtctcactggtgtgagcctccagcatccccctttgctcgaaatggaccccaactgctcttgcgccactggtggctcctgcaccgtgcgccggctcctgcaagtgcaaagaantgcaaatgcacctcctgcaagaagancctgctgttcctgctgccccgtgggcctgtgccaagtgtgcccagggctgcgtctgcaaaggggcatcgggagaaagtgcagctgctgtgcctgatgtgggaacagctcttctcccatatgtaaatagaacaacctgcacaacctggatttttttaaaaataaaacactgagccatttgctgcatttctttttatactaaatatgtgactgacaataaaaacaattttgact

SEQ ID NO: 30447 - DNA, 442 bp, Homo sapiens
  misc_feature 5, 20: n = A,T,C or G
tattnggcccgggccgtgancttcaggtctgtctgttctgttggcaagtaaatgccagtacctgttctgatcccgctgctattagaatgcatcgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttat

SEQ ID NO: 30448 - DNA, 192 bp, Homo sapiens
ggggcctgtagcccgtctctgctgcccccaggctctgcagccccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcccca

SEQ ID NO: 30449 - DNA, 500 bp, Homo sapiens
  misc_feature 3, 15, 32, 40, 41, 53, 57, 75, 86, 90, 103: n = A,T,C or G
ctntgggccgggatntccaggaactccaaccncttcaaannaccttagggacnctanttttggtgggagccaganttaaattcccntccngtaaaattagaanactgaaaccagaagttcctgggcagtttaaaatgaccctggtgcctacccttacttaaattttaaagaatagagtataaattgtaccgaagtatgttcttggacccgtaatggaattaaataagaaatcacagtaatgtagttagaaaatcctaaaatatttagagatcaaacaacacacttctaagtaacacatgggcctaagaaaaagtctcaaaagaaattttaacatattttgaattaaatgaaaatgaaaacataaggtatcaaaatttgtgagcagtagcagtgattacagggaaatttatgtattttaatgcattcattagaaaaaaataaagacctaacattaaaaatgtaagtttcaaccttaggaaactaaaaaaagaagagaaaat

SEQ ID NO: 30450 - DNA, 148 bp, Homo sapiens
  misc_feature 2, 24: n = A,T,C or G
cnccccctggggaaatttcggccntttatggcccgggagttcaaggctgcagtgagcctatgcttgcatcactgtactccagcttgggtgacagagtgaaactctatatcttaaaaataataaaaaaaacctagaaatattccaaaaa

SEQ ID NO: 30451 - DNA, 494 bp, Homo sapiens
  misc_feature 8, 44, 59, 60, 66, 71, 93, 123, 172: n = A,T,C or G
gggggganctttttgtggatcctcttttgtaagagttctaaccnaagttgcagttaacnntgtacnaagcnagttgggcctaccagtgtatantaggacggtcatagagtacctattcggccnagcaaccggggagccctgatgaaggaccgcttatgatatgaggaaagcncctttccagggatacctggagaagaaatccatcatacccattaccctcatcctgtgaggccctgaagacattgaataacccctgggcagtggttcttaggcagatacctctagatgctttatggacaatattattttcatttggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaaca

SEQ ID NO: 30452 - DNA, 193 bp, Homo sapiens
  misc_feature 10, 180: n = A,T,C or G
aggggaagtnagggagactatgctgggctgtaggagcagtgagtaggtaggtacagaaatttgaggagagtgtggtgtgatccaggagatgcaactagtatcagaactatggataaagatataactctcctgcctccccttactccaacagaagagggaggctggagaggtgggcatggnaaaaaaaaaaaaa

SEQ ID NO: 30453 - DNA, 496 bp, Homo sapiens
  misc_feature 7, 39, 43, 71: n = A,T,C or G
tcggcantttttggccggggccccgtaggagccctctcntccntactgctgctacacaagaaccctgaganctgaccctgcaggacgaaacccatgaagagccctgatccttcttgccattcctggccgccttagcggtagtaacctttgtgttatgaatcacatgaaagcatggaatcttatgaacttaatcccttcattaacaggagaaatgcaaatacccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacata

SEQ ID NO: 30454 - DNA, 139 bp, Homo sapiens
  misc_feature 5, 17, 113, 133, 135: n = A,T,C or G
tttantgggcccctgcnagggaatccccggcccgccttcggccccagtccgaactcttagaactcgagcaagccttatgcatgccggcccgcaattccgagcctcacttggcnatttcgccctatagtgggtncngata

SEQ ID NO: 30455 - DNA, 268 bp, Homo sapiens
  misc_feature 6, 7, 31, 40, 43, 57: n = A,T,C or G
tcggcnntttatggcccggggcagcctgganctcctgaanaangtggcagaggaganacccagtatgaatgctgggctctccggaccctgcagcagagaggccagaggtagctggtgatacccctgtcctgtggaaggacttccacttcaacacttccacttcaacagttcccgcacggcctgaacgcttcttaggccaagagacaccatgcggagcctagtctgtgatcctgtgtgaagatattttcagggtttttttttttttttt

SEQ ID NO: 30456 - DNA, 286 bp, Homo sapiens
  misc_feature 8, 9, 67, 77: n = A,T,C or G
ttcaaacnntcctgcccgtttaagggtacccctgtagagcccgacctttgagttacctgtgcaagangttttttttnctgcctgtcatttgtaatatgttttgtgagaatccttgggattaaagttttggttacaaattgttctttaacttgaaagcctgtttttccttgcaaactcaaatctgtgagcttggtacccaagtccaggtataacattcctattggaagccatacttatattttcttgtaaagtgcttttgaattaataaaatattagcataattgtg

SEQ ID NO: 30457 - DNA, 395 bp, Homo sapiens
  misc_feature 2, 12, 33, 72, 81, 92, 116, 167, 201, 217, 239, 247, 254,284, 313, 357, 368, 389: n = A,T,C or G
cnccccgggaanttcggcatttatggcaggganaaaagtcatgtgccaattggttgtacctaccactgctanagctatcantcacatcacanatgctgcccaggggccaaaagacncacctacctgcccagctattgttgccactaccagcacctgagcagctcacnctggaggcccacgaattggcttacttggacccantaacattggtgcttgngtacgccaccgagaggcccaangacaggcntgcttancatgctgccaccaccacttggacccaaggnacaagttcaccttggagtccttatgccancaaaactacactacggactacactgacaaccatagcctgtgccnctgcaggaagncacagacactactgatgctgnctagag

SEQ ID NO: 30458 - DNA, 497 bp, Homo sapiens
  misc_feature 3, 10, 41, 42: n = A,T,C or G
aanttcggcntttatggcccggggtattttttagtagagannaagtttcaccttgttggccgggctggtcttgaactcctgacatcaagtgatcctcccccctcggcctcctaaagtgctgggattacaggcatgagccaccacgcccggccaaaagtatatcttaattaggaaataaactttataacccgtcccagcctgtcttcatcaccatcctcttcaagtaataactagggaaattttggtgtaaatactggtgagccaaagagagtctagaaagggagtcaaataggaaaattactgcctcaattttttttttcattcatctctcctggccattgcttcatagagaagataaccagagatctttatttaccatgcctgtatttattcactgggctgctgcttttaaaaagggtggatcaagatatcttattttggtttcaaacattttttcatacagtttcaccttatcttctcatttggaccccaaaaca

SEQ ID NO: 30459 - DNA, 175 bp, Homo sapiens
  misc_feature 3, 11, 16, 19, 23, 32, 34, 37, 51, 61, 68, 75, 96, 118, 173: n = A,T,C or G
tcntttggganctaantcncccnaaaaaagcnanccnaacctttaagcccnagttttttanttttgcnaaaaacnaagggaaaataaaagggcctntacctttctttttaaaaaaaantaaaaaaaaaaaaaaaaaaaaaaaaaaaaaaaaaaaaaaaaaaaaaaaccccccnaa

SEQ ID NO: 30460 - DNA, 473 bp, Homo sapiens
ggtagagtaaaaagttctttttaaggttcttaactaattttttcacaactaagaaaataaatgaagtattcttaggctgaaattcatcttattttatcataaattagattgtaggggcagcctacatttttgtgtatgtgtttttatttcttaaatgattgtgtgagcctggtgacattttatggttcttgtgatctaaactgtttttccaattcacatcttttgttgtgaagtgatattatactagagtactgtttgcattgtaaaaatgctttgctggtgctctggcattttgtctttatctcatcacctaatttaaaaacccagcacttgataatataactgacagaaatgattgtacccactgatgaagtaatgaaaatgaagaaaaggaaaatattccttccttcaatggcgtaagtttattttttacttaagtggcatctatggtaagttagacaaactatatatta

SEQ ID NO: 30461 - DNA, 468 bp, Homo sapiens
  misc_feature 16, 37: n = A,T,C or G
attgcacaaataaccntgttctttggtaatgaagccngaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatgggggctgtattagattatctgaatcatttgtctaaagagggacattcttccagatggaatcaataacttttttttttccaggttcccgtgc

SEQ ID NO: 30462 - DNA, 435 bp, Homo sapiens
  misc_feature 11, 414: n = A,T,C or G
gctttcctttngcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgcttgcggttcatcatgganaagtggggccaaaggctgcga

SEQ ID NO: 30463 - DNA, 271 bp, Homo sapiens
gatgcagtagctcacacctgtaatccagcactatgggagactgaggcaggaggatcacctgaggtcaggagttcgagaccagcctgactgacatggcgaaacaccatctctactaaaaatacaaaaaattagccaggcataatggtgggcgcctgtaatcccacctacttggaaggctgaggcaggagaatcacttgaacccaggaggtggaggttgcagtgagctgagatggcgccattgcactccagcctgggcaacaaagtgagactc

SEQ ID NO: 30464 - DNA, 391 bp, Homo sapiens
aagacatgtgattcaatatttctgctaattaaaccatggctgtcttagcccatttgggctgctataatgaaaatatcatagattttgtgccttataactgaaatgcatttctcatttgtgaaggctgagaggtccaagatcaaggtgctggctggtttggtgcctggtaaggagctgcttcctggttcagagatggctgtctccttgttatagtttcatgtggtagaaagggcaagggggttatctggcatcccttttataagagcactaatttcattcttgcccttatgacctaatcgcctctcaaaggctctgtattaatctcttctcacgctgctataaagaactacctgagactgggtaacttatgaagaaaagacgtataaattga

SEQ ID NO: 30465 - DNA, 500 bp, Homo sapiens
  misc_feature 3, 10, 33, 36, 37, 56, 73, 74, 77, 93, 136: n = A,T,C or G
acnccgagtnctggttggccccgggcccgaganganngctgctggcaaagggggancgtcccaaccgaaagannccncctgtcctttcgagcnaggagttaacacccgtcacccacctttggtgggagaacaaganagctcagctggtgggtgattgcaccaccgacgtggatcccatcgagcctggttgtcttcttgcctgcccctgtgtcgtaaaatgggggtcccttactgcattatcaagggaaaggcaagactgggacgtctagtccacaggaagacctgcacccactgtcgccttcacacaggtgaactcggaagacaaaggcgctttggctaagctggtggaagctatcaggaccaattacaatgacagatacgatgagatcccgccgtccttggggtgggcaatgtcctgggtcctaagtctgtggctcgtatcgccaagctcgaaaaggcaaaggctaaagaacttgccactaaactgggttaaatgtcac

SEQ ID NO: 30466 - DNA, 479 bp, Homo sapiens
  misc_feature 58, 59, 76, 88, 89, 463: n = A,T,C or G
atcccttctgcataatgaattaactagaataactttgcaaggagagcaaagctaagannccccgaaaccagacganctaccctaagannagctaaaagagcaccaccccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgtngtattaagtaacattg

SEQ ID NO: 30467 - DNA, 498 bp, Homo sapiens
  misc_feature 3, 17, 33, 47, 449, 475: n = A,T,C or G
ccngggaatttcggccnttatggcccggggagnccttgaggccgccngcgccaggggccttctgctgagggggcaggcggagcttgaggaaacccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagttaaaagttgngagggtgattaaaataattttggaangccgatcttttaaaaaagagatt

SEQ ID NO: 30468 - DNA, 394 bp, Homo sapiens
  misc_feature 7, 14, 33, 42: n = A,T,C or G
aaagccnaatttcngtttaagtaattgtctacnataaaaganattttgcctgcctttttcagaatcctcttttgaagctttctgttgatgttaacctgagctacctagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattc

SEQ ID NO: 30469 - DNA, 470 bp, Homo sapiens
  misc_feature 5, 17: n = A,T,C or G
gaggnttgaggcagccngcgcaggggcttctgctgagggggcaggcggagcttgaggaaacccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttggaaggcgatcttttaaaaagagattaaaccgaa

SEQ ID NO: 30470 - DNA, 275 bp, Homo sapiens
  misc_feature 8, 9, 53, 66: n = A,T,C or G
ttcggccnntttatggcccggggggggaaatcccgactgtttaattaaaaacnaagcatcgcgaangcccgcggcgggtgttgacgccgatgtgatttctgcccagtgctctgaatgtcaaagtgaagaaattcaatgaagcgcgggtaccaccggcgggagtaactatgactctcttaaggtagccaaatgccctcgtcatctaattagtgacgcgcatgaatggatgaacgagattcccactgtccctacctactatccagcaaaaaaaaaaa

SEQ ID NO: 30471 - DNA, 318 bp, Homo sapiens
  misc_feature 16, 17, 40, 89, 104: n = A,T,C or G
gttggaccccctagannggtgatggccaaaggtttagaancccccttacttttcaaagaacctaaatctaaaacccccagagtaaaccntcaatgcctccaganttagccactaatttggagcctatttcaggaaattgcagagaaatgcccttttcacagaaatcaagatgttatttttgtatacctatatcacttagacaacctgtgtttcatttgctgtaatcagtttttaaaagtcagatggaaagagcaacctgaagtcctagaaaatagaaatgtaattttaaactattccaataaagctggaggaggaagg

SEQ ID NO: 30472 - DNA, 451 bp, Homo sapiens
  misc_feature 7, 15, 31, 56, 410: n = A,T,C or G
cgggaanttcggccnttttggcccggggtcnattctttttgcgaggatccttaacnagccaaatgtctaattccttggttaccctcactggaggttttctttaacccttttaagatttcaggagtaccaaaaggaacctgtgacaattctaggtccttgaacccctaggacccatttctaaccacaagagagatttcgagtgatcctttatctcagtgtataagtcatagatggattaaatttatgagacataatctcaaaaattgtaacactggcaaattcacctgtatcatttactcactcaacaagttacatttctaggtgtatagtaggaacaaaacagaccaatatccctgccctcatggagcttgcagttttgggggagacaggcagtaaacaaagcattgganttagatggtgataattggtggaggaaaataggaagcagaga

SEQ ID NO: 30473 - DNA, 182 bp, Homo sapiens
  misc_feature 2, 4, 12, 13, 35, 181: n = A,T,C or G
cntntagaagannctaatgttagtataaagtaacnatgaaaaacattctccctcccgcataagccctgcgtcagattaaaacacctgaacctgacaattaacagccccaatatctacaatcaacccaacaagtcattattacccctcactgtcaaccccaacacaggcgtgctcattaagna

SEQ ID NO: 30474 - DNA, 344 bp, Homo sapiens
gctttccggcggtgacgaccctacgcacacgagaaatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccggcctacaggaggaaaagcaaggcttacagaaggatgttccttcaggaggaagcagcactaaaagcactctgagtcaagatgagtgggaaaccatctcaataaacacattttgaaa

SEQ ID NO: 30475 - DNA, 163 bp, Homo sapiens
  misc_feature 1, 17, 150, 151: n = A,T,C or G
ntggcttggcgtgtccnaacagaaatagtttttgctgttgaacggtgatttctgtccaagtgcagatttccgtttgaataaagcttcgcttctaggtggcactgtttgccttaaaaaaaaaaaaaaaaaaaaaaaaaaaaaaaaaaaaannaaaaaaaaaaaa

SEQ ID NO: 30476 - DNA, 125 bp, Homo sapiens
  misc_feature 2, 3, 7, 11, 16, 31, 56: n = A,T,C or G
cnnaaantaanacacntgcgggagtgtgctnaaagtactatgagaagaatggaccnttgttgctccactgtattttaacatgtatttagtaaaactcatcaattagatatgatagagatgaagca

SEQ ID NO: 30477 - DNA, 163 bp, Homo sapiens
tccctttgtatttttagccaacctcagaagccccctagtgtcccttgggcttaaaagccagtgtcctttgggagtttgttgaggggtgggaccaaaaaaattaccaataccgttaaaagaatgagtggaaagccaagaaagcattaaaatcaagatgttttct

SEQ ID NO: 30478 - DNA, 473 bp, Homo sapiens
actcccaaaatctccagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaaagatgtacggagacatggcatgaagccagagagtgagagacattaactcattagactggaacttgaactgattcacatctcatttttccgtaaaaatgatttcagtagcacaagttatttaaatctgtttttctaactggggggaaaagattcccacccaattcaaaacattgtgccatgtcaaacaaatagtctatcaaccccagacactggtttgaag

SEQ ID NO: 30479 - DNA, 471 bp, Homo sapiens
  misc_feature 7: n = A,T,C or G
aagcatngagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctga

SEQ ID NO: 30480 - DNA, 463 bp, Homo sapiens
  misc_feature 15: n = A,T,C or G
tatggccgggtaccnaatatgggttaccctattccttttttactccttcagccttccaactcctatattactgatttcctgtcttaaattagtttgaaatacctacatggtctctttacccggtaagcccctaattggtacttattaggattcaagctccagggtctactatttaaagctctctacaatctaatttcagcctatttctccaatcacttccctcatgccagctgacaaacatttaatcccagccaaactagtttgctcatgtctcatgaacttgtcttgcatttttccgtgtccacatctctgcaaaggcaatgaagtggggcaggaaacatgcactggctgtggcactagacctctgtttaaatcttagctctaactcctattagctataagacctaaagcaagtcactagccctttataagcctcgggttgttttcgctggaaaacaaggaa

SEQ ID NO: 30481 - DNA, 472 bp, Homo sapiens
catgagtagacaattctcaaaagaagatatacaagtggccaacaaacatgaaaaaatgctcaacatcactattgatcagggaaatgcaaatcaaaaccacaatgcaataccaccttacttatgcaagaatggccatagtcaaaaagccaaaaaataatagatgttggcatggatgcggtgaacagtgaacacttctacactgttggtaggaatgtaaactagtacaaccactatggaaaacagtgtggagattccttaaagatctaaaagtagaacaaccatttgatccagcagtcccacttctgagtatctgcccagaggaaaagaagtcattatatgaaaaagatatgaattaatggcatttgcagcaacttggataagattggagactattattctaagtgaagtaaccgaggaatggaaaaccaaacatcgtatgttctcactcataagtgggagctaagttatgata

SEQ ID NO: 30482 - DNA, 432 bp, Homo sapiens
agaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgagggaggtgggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaactttttccttccctattaaaattagaacctgagtataaatttactttctcaaattcttgccatgaga

SEQ ID NO: 30483 - DNA, 497 bp, Homo sapiens
  misc_feature 6, 392: n = A,T,C or G
tttatnggccgggatatgaagtgtgtgtgagagagagagagagagctgacagcattgtttgagtgtctggatctagccattcctgtggtggctccgtctagtccttgtttatatgagtgaatacatcctcttttaactgaagccagtttgtgttgggtttctgtcccttaaaatcaagagtcctgagaaatacaatattggtcaaaaaaagtcttcatagaacaggtgaaccaggaaaaaagggattcaccagaaagataagaagagaggcagagagtgaatgtaacagcagctacatttggaggaagtacgagcagctcaggatgacttgagctgagatgtgtaatcccagcactttgggaggccaaggcaggtggatcacctgaggtcangagttcaagaccagtctggccaaagtggtgaaaccccgtctctactaaaaatataaatatgagccaggcgcggtagcgcacccttgtaatcccagctactccgga

SEQ ID NO: 30484 - DNA, 322 bp, Homo sapiens
  misc_feature 7, 319, 320: n = A,T,C or G
gagactnggaagattcaggaagcctctagattacttcagtgataaagagtctggaaaacaaaagtttaatgattcagaaggggatgacaccagaggaggcagaggattatagacagttcaggaagtcagtcctcgcagatcagggtaaaagttttgctactgcatctcaccggaatactgagggaggaaggactcaagtacaagtccaaagtttcactgaaaggcaatagagaaagtgatggatttaggagaagaaaaaaattataaacttaaagagactggatatgttagtgggaaaggcctagcactacaaaagatnngc

SEQ ID NO: 30485 - DNA, 350 bp, Homo sapiens
  misc_feature 6, 16, 43, 97: n = A,T,C or G
acaganctttgcgaancgctacgcccatggtttattggatacnaatgctgccctataatcgctacttcaggaagccgccgagggaccaaatgaaganctgagggaaagaaaaaaaatctctttttttctggaggctggcaccctgattttgtatcccccctgtagcagcattactgaaatacataggcttatatacaatgcttctttcctgtatattctcttgtctggctgcaccccctttttcccgcccccagattgataagtaatgaaagtgcactgcagtgagggtcaaaggagagtcaacatatgtgattgttccataataaacttctggtgtgatactttcaaaa

SEQ ID NO: 30486 - DNA, 489 bp, Homo sapiens
  misc_feature 4, 17, 18, 21, 26: n = A,T,C or G
tatngccgggtaagaannccnaattnctgtaataggtaatgaaactgaaactatactatgccccttaaggagatccagtttaattcaaggtgatcttttatttaccctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttatttttttttactatagagtgagggggttgttaacaaagaatatatattggtcattcttacaactactatttaaagtcagcaacttttcactgaatttgataattttatgggtttggccatatcttcatgctcacatttgatttctgaagacctcctacatacacttcaataaaagttaaatggacatactccctcttttttgatttactggtacattttt

SEQ ID NO: 30487 - DNA, 102 bp, Homo sapiens
  misc_feature 8, 17, 36: n = A,T,C or G
ccgggaanttccggccntttatggcccgggggaaantttgtgcctgtggacaggtctttttactcccttccagttctcctccaaaactggagaaaaaggaaa

SEQ ID NO: 30488 - DNA, 463 bp, Homo sapiens
  misc_feature 6, 420: n = A,T,C or G
tttatngcccggggggtttggtctcagactggtttttcatgcctaagttcttcttacccctcaggcatctgggattttacctgtttttcttccagtggtgtgccctctccgccacattgtggagcgtgctttctcaatccttcaggaagaaattcaaagactttgttttttaacaatatgcaggatgggcgtagtggctcatgcctgtaattccagcactttgggaggctgaggtgggtggatcacttgaggtcaggagtttgagaccagcctgaccaacatggtgaaacgctatctctactaaaaatataaaaattagcctgggtgtcattggcaggcacctgtaatctcagctgctcaggaggctgaggcatgagaatcactttaccctgggaggcggaagttggtaatgaacctganatcgcgccactgcactccagcctgggtggcagagcgagaccgt

SEQ ID NO: 30489 - DNA, 353 bp, Homo sapiens
  misc_feature 3, 17, 48: n = A,T,C or G
ccngggaatttcggccntttatggcccggggtgctatagatgaaagantttaatgaaatgagaaatactgttatcaatagtgaattttctcagtcaggaaaactggcaagtacaatatcaattgatcctaaagttaacagttcacccagtgtgtgtgttcccagtctcatatcatatttaacacagactgaacttgcagacattagcatgcttagaagtgactctgaaaacatacttacaaactatgaaaatcaaagccgagtggaaacaaatgaacgtgcaaatgaatgtagtcattctaaaaacattcaaaactttccaagtgatttaatagaaaatcctattatgaaaaa

SEQ ID NO: 30490 - DNA, 364 bp, Homo sapiens
caagccccattatgagctcttaagtaatcctgtgggattatgcctggtacattagttgcatagtgaataaaaataggcccttatgaacaaaataatgtcttttgctgcaacttgcatggaactggaggccattattctaactgaagtaactcaacaatagaaaaccaaatatcatatattctcacttgtaagtgggagctaagctatgaggatgcaaaggcataagaatgatataatggactttgggaactcagagggtaaggttgggatgcgggtgagggataaaagactactatgtatatatacatatttttagacagcatctcactccagcctgggcgacagagcgggactctgtctcaac

SEQ ID NO: 30491 - DNA, 390 bp, Homo sapiens
  misc_feature 2, 6, 35: n = A,T,C or G
cncccngggaattcggcattatggccggcaagagngtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcgga

SEQ ID NO: 30492 - DNA, 251 bp, Homo sapiens
gaaggaccttgggctggagctgtggactcggtgctttattcgttctaagatgaaagtcattcattctggatggctatgaccttgagcgactcacttctctccaggctccaggtgtccccttcattcatttgttaacctttattaagcacctcccatgggccgcagtcaggccctggggattcagcagtgaatgaaactgacaaaacccctgacctcattaaactgacattcttttttttctttttaaaaaa

SEQ ID NO: 30493 - DNA, 371 bp, Homo sapiens
gggcgagaaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaaagatggcctgttgaatctgattcggactatgccaggcaagaaatccaagtatgaaatagcagttgaaactgagatgaagaaaagagtccaaactggagagaacaccccaaaa

SEQ ID NO: 30494 - DNA, 265 bp, Homo sapiens
  misc_feature 15: n = A,T,C or G
cacatggcaacagcncacagtcattgccttcaacacagagccacgtgtccccaaacagcaatagtcatgcccttgtccaggctgggatctaattgatacaataggtcgttgactccctcctagtagagctatctaggtttgtctggaaagtttccgaccctggcttataggcaccacacctcatgtactcctcatggcttggatctctgtattcagcctttgttcagtccaataaactttgaggtagatgatctcaaaaaaaaaa

SEQ ID NO: 30495 - DNA, 244 bp, Homo sapiens
  misc_feature 227, 228: n = A,T,C or G
agggaaaggttgcatggagccggtggggtggtgatagttagggactcaggtatccattttactggatgtttcagactgtttacagatctgctgctcatgtcttgctggggaaagccaggcaatgccaagagctaagcatttggtggatactaacctcctggttgaaaagaaccctttgtcctgctgtttgatgctgtgaaagagaatcctcaaactgtcagaaagcnnaaaaaaaaaaaaaaaa

SEQ ID NO: 30496 - DNA, 298 bp, Homo sapiens
gttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaa

SEQ ID NO: 30497 - DNA, 331 bp, Homo sapiens
  misc_feature 30: n = A,T,C or G
ggggggaggtggcttcttccggccgggccnagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaa

SEQ ID NO: 30498 - DNA, 329 bp, Homo sapiens
  misc_feature 30: n = A,T,C or G
tgtttcagcttttgtggctattattaatantgttgacatgaccattcatatacaagtttgtgtggggatggatcttttcaatcctattgggtatatacctccaaacggatttgctgggtcatatggtaactctatgtgtgactttttgaggagctgcaagactgttttccaccattactacagcattttccattcttaccaagggtatatgaagttccaatttctccccacctgcaccaaaacactcttccaattttaaaaattattatagccattttagtggatgtggagtggtatctcactgtggttttgatttacatttccctaac

SEQ ID NO: 30499 - DNA, 420 bp, Homo sapiens
  misc_feature 31: n = A,T,C or G
agtcctgctctcctgtgacctgtggagagcnctaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaaga

SEQ ID NO: 30500 - DNA, 395 bp, Homo sapiens
ggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatg

SEQ ID NO: 30501 - DNA, 288 bp, Homo sapiens
ggtgaaagcctcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccca

SEQ ID NO: 30502 - DNA, 222 bp, Homo sapiens
gacgccaaggcgtaagaatgatacaatggactttggggacttggaaggaagagtgggaggggggtgagggataaaagactccaaatatggtgcaatgtacactgcttgggtgatgggtgcaccaaagtctcccaaatcaccactaaaaaatgtactcatgtaaccaaacaccacctgttccccaataacttatggaaaaataaagtaataaaaattaaaaac

SEQ ID NO: 30503 - DNA, 341 bp, Homo sapiens
  misc_feature 32: n = A,T,C or G
gcttttcctgtggcagcagccgggctgagagnagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacat

SEQ ID NO: 30504 - DNA, 372 bp, Homo sapiens
  misc_feature 3: n = A,T,C or G
atnaaaaggaagtatagttttaaaaattgtgcatgatttttactggtgacaattaaaatttgctttgagtgttttaatggttgttaataagaatttgtattttatctttttccagcttaaatagagtttataaatataagccattgctgatcagtagtgttacgtatgtgagcacatgcattcacattgggttgcatttcatagctactgaaccaaatgatgaatgatttggcacttggagaaaataaatttggcatttggagagatatataaattcttcttggttggatactcattacttcctcagttcagaatgaaaaaattttagacccttgaaattcctggataattctgggccaactgagtcagtga

SEQ ID NO: 30505 - DNA, 178 bp, Homo sapiens
ggattaaagactaaaacgtaagtacctgaaaccataaaaaccctaggaagaaaacctaggcaataccattcagggcattggcatgggcaaagacttcatgactaaaatactaaaagcaatggcaacaatagccaaaatggacaaatgggatctaattaaactaaagagcttctgcaca

SEQ ID NO: 30506 - DNA, 142 bp, Homo sapiens
tcttattgatacaggtgcaatctactaaattgctatactggatgatggatgattgatggatggactttacacatttgattttgccaggaaattatatattgagtgtaatggtcaccatgaaattggaatgcggaaaatacta

SEQ ID NO: 30507 - DNA, 472 bp, Homo sapiens
tttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagcgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattat

SEQ ID NO: 30508 - DNA, 176 bp, Homo sapiens
atagccttaagttaaagcattactttacctaacttcttttaactttcaggttatcctagtctaagctgtttacttggattttcctcttttaattcttgtattcatctctgttgatcctagtattctgataacagattctaataattccccaaccattccccaaagctgccccatat

SEQ ID NO: 30509 - DNA, 353 bp, Homo sapiens
gggtctgaaccttactgcccatacaagtgttgattcattttaatgctgtttatgatttctgcattggcagaaattttcatactttctatgtttttttaattactcagttttttattactaaaaatagcacatttgagtacatttgaaaagtagaaaaattagaaattattaactttattgaataagcaagaagtgcatcctaatcctttgattattaatgaggttgaatatttgtgtgctatcggtagctgtgtttctttgatcagatgttcctgtccttttgcccttctgttatctgttggagttgctttgtttttcgtatcaagttataggatctctttatataataaatg

SEQ ID NO: 30510 - DNA, 429 bp, Homo sapiens
  misc_feature 6, 22: n = A,T,C or G
cagctncccctttttctatgtnagaaaccatgatgtgtttcaaggctagctaaattactgtttgttaatgttaagcatttttcagaggtgagattgtagtttaagggttttggatacatatttcacatattttaagcattttattttgcttaagtctacttaaatgtttttaaacctttattgtgatatgtagcatccataaagaaaagtatacaaaaaacatacatacatattcacatacatccaggaattattatgaagcaaataccgagataccacaacctagttcaagaactagaacattatcagcatcccagaagccatccttcctccctaacaaaagtgtctagcatcacgacttttatggtaatcattttttgtttctttatagatttactgtttaagcatgtatccataaacactagttta

SEQ ID NO: 30511 - DNA, 120 bp, Homo sapiens
  misc_feature 41, 97, 113: n = A,T,C or G
atgaaaaattgaggctgctgccccacctttccatgccctcnagctgaatgtgctcctgactttttaatgatcgccattctaactggggtgagatggnatctcattgtggtttnagattag

SEQ ID NO: 30512 - DNA, 263 bp, Homo sapiens
  misc_feature 2, 16, 22, 40, 65, 127, 157, 159, 167, 175, 180, 181, 184,189, 192, 193, 194, 195, 196, 197, 198, 199, 200, 202, 208,209, 210, 215, 218, 220, 226, 231, 232, 236, 238, 241, 247,248, 249, 250: n = A,T,C or G
antttgacccaggganctcggncttatggccgggatggtnccaggatttggattttgattttccnaatgtagcttgaaatttcaataaactttgctctgtttttctaaaaaaaaaaaaaaaaaaaanggaaaaaaaaaaaaaaaaaaaaaaaaaaancnttttgggncccccggnccccnnccnttttnaannnnnnnnncntttttnnnggggnccnanttgggnccccnngggncnatncccccnnnnggggggggggaaa

SEQ ID NO: 30513 - DNA, 168 bp, Homo sapiens
caataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaa

SEQ ID NO: 30514 - DNA, 214 bp, Homo sapiens
aattgttcagttggtgtacaccaaacacttttagagaaaataccattttcatttaaaaaaatgaaatataattcactaccatgaaattgaaagtgtacaattcagtgagttttagtatattcacaaggttgtgcatccactaccactgtctaatttcagaatcattattttattttttaaatttttttatttttttgagaccttgtctcggaaa

SEQ ID NO: 30515 - DNA, 444 bp, Homo sapiens
  misc_feature 6: n = A,T,C or G
agattncccatactagtatgttgtaatgctgttttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactg

SEQ ID NO: 30516 - DNA, 358 bp, Homo sapiens
gattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggca

SEQ ID NO: 30517 - DNA, 396 bp, Homo sapiens
  misc_feature 7, 32: n = A,T,C or G
atggaanaaaataaaatataggattatctgantatttgtttcatgcaaatacttagatttctgtattgtgacctcttcctttgacggtcacgatacagatataagttcttttctgaagtatgtaggtaaggtctgttctagtaaaaatggagaagataacagattgaatttgatgtctccatcacctagtgacccgtctgtgtgggttcagcaaaaagtgcaagatagtgctggttacctaggttacatacacaggtatatgagatcagccttagctctcttggagctgctaatgtagaacctgagaaacatcaataagcagcacttcctaagtttgagcttgggaagagttatttttcattgactagtatatgacgtcagtatccgtttttatga

SEQ ID NO: 30518 - DNA, 380 bp, Homo sapiens
atggccgggaattttaggaagattttacaatatatatttgaacatatttttggttttgtttgttctattttcaggttaagaaaaacttatgatgtgtgtatggaatctgctttcaaatcaattttattttccttctttgcttccttttctttattttttctttattatatgtactatttcctcaagtgttttctttatatacctcattctatttcagcaatatctattctacttcttactgcttctaattagttttaattcttccaattactttattatcttcaagtctcttttctgcttttccagctcagttttcatctttcagtgatttgtttgctataaatttttcatatttgttttgatcctaggttttcagagaa

SEQ ID NO: 30519 - DNA, 221 bp, Homo sapiens
cgcaggcaactgtgtgtgtcctacacaatggtgctattctgtgtcaaacacctctgtattttttaaaacatcaattgatattaaaaatgaaaagattattggaaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 30520 - DNA, 408 bp, Homo sapiens
gagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtac

SEQ ID NO: 30521 - DNA, 420 bp, Homo sapiens
  misc_feature 31: n = A,T,C or G
ggattcatttagaagtgtaactggtgctgtnattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgac

SEQ ID NO: 30522 - DNA, 212 bp, Homo sapiens
  misc_feature 32, 207: n = A,T,C or G
taagttatttatgtatgaaacaaagcaggaanatatattgagaagggatcgtgtttacagaggacttctttaaagtgtcacatttttaaaatgtaaacatatttttaatgcatacttaagtaatatttaagaaactaaacaaaataatgatacaattgcagtgttgtgcttgttgtcaatgacaaaaataaaaccattttggtggtnaaaaa

SEQ ID NO: 30523 - DNA, 118 bp, Homo sapiens
atggccgggatccatgattatttcctgagaaaaaattcctagaatttgacacactaggtcaaagggcaaattatgtttacttaagaaattaaattaaaacaaaaaaaaaaaaaaaaaa

SEQ ID NO: 30524 - DNA, 253 bp, Homo sapiens
  misc_feature 30: n = A,T,C or G
agttccaccttgtggaagacagtgtggcgnttcctcaaggatctagagccagaaataatatttgacccagtaatcccattactgagcatatacccaaaggattataaatcattctactaaaaagaacatgcacacatatgtttattgcagcactattcacaatagcaaagacttgaaaccaacccaaatgcccatcagtggtagactggataaagaaaatgtggcacatatacaccatggaacactatgcagc

SEQ ID NO: 30525 - DNA, 209 bp, Homo sapiens
agtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagtc

SEQ ID NO: 30526 - DNA, 388 bp, Homo sapiens
aaggaaaggtaaagtggatgtaatcgggtggttgttagggtttggggctaggtggggccaattgcataagcagtggagtgtgttcttcccctccctgcagtgttccttcccgtgggatgatcactctttagctgtatttggggctagaatgagatttgaaggaggccatggaacttctctttagaaagcctgccttggctgggcctggtggctcacctctaatcccagcactttgggaggccaaggtgggaggattgcttgagcccaggaatttgagactagctggggcagtgtagtgagactttgtctctaccagaaaaccgggcgtggtggcgcatgcctgtaatcccagagaattgggaggctgagccatgagaatcgcttgaac

SEQ ID NO: 30527 - DNA, 308 bp, Homo sapiens
  misc_feature 5, 29: n = A,T,C or G
cactnttaccgcttctattcacataatantggaagtcctaaccagagcaatcaaacaagggaaagaaataaaaagcatctgaagtggaaaagaataactcagattgtcacgattcatcaatgatatgataatatgcttagaaaaccctaaagactcatccaaaaagctcctagatctcataaacaaattcagtaaggtctcaggctacaaaatcaatgtacacaaatcagtaggcaccaacaatgactaagccaaaaataaaatcaagaactcaatcccttttcaactgctgctgaaaaaaaaaaaaa

SEQ ID NO: 30528 - DNA, 130 bp, Homo sapiens
gactcttagcggtggatcactcggctcgtgcgtcgatgaagaacgcagctagctgcgagtaattaatgtgaattgcgggacacattgatcatcgacacttcgaacgcacttgcggccccgggttcctccc

SEQ ID NO: 30529 - DNA, 263 bp, Homo sapiens
  misc_feature 262: n = A,T,C or G
tgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaant

SEQ ID NO: 30530 - DNA, 409 bp, Homo sapiens
  misc_feature 31: n = A,T,C or G
gaggccttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttta

SEQ ID NO: 30531 - DNA, 270 bp, Homo sapiens
  misc_feature 31: n = A,T,C or G
gacctctctcaggcttagcctgggctgtagntatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaaaacg

SEQ ID NO: 30532 - DNA, 420 bp, Homo sapiens
  misc_feature 26: n = A,T,C or G
atagcacgcgtgatgaccaacaaagnatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgattttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcaga

SEQ ID NO: 30533 - DNA, 166 bp, Homo sapiens
  misc_feature 160: n = A,T,C or G
atagccttaagtcttactgttttgtgcggtgtgtctccagctgattttaacttttttgatggtagaaattttatctcttcttccttttgtatcctccattgtatcttcatacaaaggacagtacacacttgggtaattaaaaataaaagttgattgaccntaaaaa

SEQ ID NO: 30534 - DNA, 489 bp, Homo sapiens
  misc_feature 3, 5, 30: n = A,T,C or G
ggnangaggaagtcacactgtcactgtttncagattatatgatcatatacctagaaaatcccaaagactcatccagaaagctcatagatctgataagtaaagcttcagaatacaaaatttatgtacacaaatcattagcactgctatataccaacaattactaagctgagaaacaaatcaagaattcaatcccttttacaacagctgcaaaaaaatatatgcctaaaaatatacctaaccaaggaggtgaaagatctctacaagaaaactacaaaacactgctgaaagaaattatcaatgacataaacaatggaaacacattccatgctcacggatggatagaatcaatactgtgaaaatgaccatacagccaaaagcaagctacagattcaatgcaattagcatcaaagtaccatcattattcttcacagaactaggaaaaacactcttaaaattcatgtagaacctaaaaagaccttgcatagccaa

SEQ ID NO: 30535 - DNA, 333 bp, Homo sapiens
tgctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcaga

SEQ ID NO: 30536 - DNA, 423 bp, Homo sapiens
caggtgcaaagatgagaggaagttctcatatgtcatgttgactcagaaaacaaattgataaaatactctccttgagtaagagttccttgtagagataatttgacaatgtcagtgatagaactgaaagtgaaggtatttgaaccagtaataattttagaaaattatttgacagaatctacagaggatgaacacatgcctaccttctaacagttgcactcccaacattcactcagtagcaacccatccatttggtcgcctaaaaatatgtataagagatttttgttcatggccgtgatggggtaacctagcagttttaccctcctgttttaaacaatggtaaaactagatcaatgcgtgagttaacattgaatataaaaatcctacataggtaaaccaagaaccttgaagaatttgaaagagttg

SEQ ID NO: 30537 - DNA, 295 bp, Homo sapiens
  misc_feature 243: n = A,T,C or G
caataagaacgcacacgttgtgtcgcccgctgtggctctaaggcctaccaccttcagaagtcgacctgtggcaaatgtggctaccctgccaagcgcaagagaaagtataactggagtgccaaggctaaaagacgaataccaccggaactggtcgaatgaggcacctaaaaattgtataccgcagattcaggcatggattccgtgaaggaacaacacctaaacccaagagggcagctgttgcancatccagttcatcttaagaatgtcaacgattagtcatgcaataaatgttctg

SEQ ID NO: 30538 - DNA, 346 bp, Homo sapiens
  misc_feature 6, 32: n = A,T,C or G
cagaantcacagcttgctaatgagaagctgtnccagttacaaaagcagctagaagaagccaatgacttacttaggacagaatcggacacagctgtaagattgaggaagagtcacacagagatgagcaagtcaattggtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaagctcgaattacatctttacaagaggaggtgaagcatctcaaacataatctcg

SEQ ID NO: 30539 - DNA, 254 bp, Homo sapiens
  misc_feature 25: n = A,T,C or G
atcgccatcatgaacgacaccgtanctatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgc

SEQ ID NO: 30540 - DNA, 490 bp, Homo sapiens
  misc_feature 7, 34: n = A,T,C or G
cataccnagtagaaaaatttatttaaaatttttntggaaccaaaaaagagcccaaatcgccaaggcaattctaaacaaaaagaacaaagctggaagcatcacactgcccaacttcaaattatattgcagggctgaagtaaccaaaacagcatgttactggtacaaaaacagtcacacagaccaatggaacagaatagagagcccagaaataaggccacatacctatgaccatcagaccttcaacaaacctgacaaaaacaagcaatggagaaaagactccctgttcaataaatggtgctgggataactggctagccatatacagcagattgaagctggatcccttccttacaccatatacaaaaaatcaattcgagatggactaaagacttagatgtaaaactcaaaactatacaaaccctggaagacaacctaggcaataccattctggacatagtaacaggcaaagattttatgacaaagacaccaaa

SEQ ID NO: 30541 - DNA, 239 bp, Homo sapiens
aggccaaggcgggtggatcacttgagatcaggagtttgagaccagcctgaccaacacagtgaaaccctgtctctactaaaaatacaaaattagccaggcaggtggcgcatgcctgtaatcccacctacttgggaggctgaggcaggagaatcacttgaacccaggaagcagaggttgcagtgacccaagatcgcaccattgcactccagcctaggcaacaagagcgaaactccatctca

SEQ ID NO: 30542 - DNA, 369 bp, Homo sapiens
aaaattggatatccatatgcccaaataacaagactagaccttcacctctcaccctatacaaatacaataaatataaaatcaattaaaatgtataaaaaacctaaatgcaagatgtaaactaacactactagaggaaacatagagaaaacacttcaggacatttgtctgggaaaagattttatgaataagacctcacaaacataggcaacaaaagcaaaaataaacaaatgggattattgcaaatttaaaaacttctaaatgacaaaggaaacaaccaacagagtgaaaaagtaatctacaaattgggaaaaaatatttgtaaactacttatccaacaggggattaataaccaaattatagaagggatgc

SEQ ID NO: 30543 - DNA, 411 bp, Homo sapiens
gcttgaggctcttgggtggcaggttctaaaagaaagccagactttctagaacacaagagcagttggccaagaggtaggtaggacccaaattataccagagcttggtggccatattgaggaggacatgggatttcattctaactgcaggaaaaagccattgaagatctttaagcatggaattggatggagtgacttaagtgtttcagagatgactatggctgttgtgaatgcattgaaggggataaggagaccagggaaaccagttaggagctactgctcgggtaagagttgatggtggttagttgaatgtatcagcaatgaacttgcaattgaaggtcaaagctaactttaaattaaactcttaagaatattattggtggtgtgtctcccaagaaaaatacctgtctaaga

SEQ ID NO: 30544 - DNA, 281 bp, Homo sapiens
  misc_feature 7, 14, 31: n = A,T,C or G
catgcanctaggcnggtgcagtgtctcttgnctgaaatcctggcactttgggaggctaaagcaaaaggatagcttgagcccaggagtttgagaacagcctgagcaacatagcaagattccatctctacaaaaatttttaaaaattagctggggcatggtggcacatacctcttgggaggctgaggcaggaggattgcttgaacctaggaggccaaggctgcagtgagccatgatggcaccactgctctccagcctgggtgacacagaaagattttatctaa

SEQ ID NO: 30545 - DNA, 488 bp, Homo sapiens
gaagtagcagaaagggaatcccccaacctctcattcacacttacctggaatttagcctctgtatcacagagcacaggagaatcagaaatgctaaaaacctgcccctccagggaagattctacaccacttgacttggagcttagagaggagggtaccctatcttcttggccacatctttttggaatggagtttctttgaactgtggggcaggggagggaggatagggagagagtaggtcatgactcaaatgctacagatgctcattgttcttaataagatttagtcgatttaaaaaaatatttcatcatctgctatatgccattataacaatttcagagactttagcttcttaaaaaaatattttttatcaattatggttgttccactgggcagagagccacagagctcctcacattgtcattttggaagcagattctaagtttgatttcaaatacctttagtcacagcagttactatccagttgacca

SEQ ID NO: 30546 - DNA, 176 bp, Homo sapiens
  misc_feature 26: n = A,T,C or G
aataagtgtaactcagattctggacngttcgagtttacaatacattgcctgtaataaaagctgattctgaagtgcatttttcttgacttactttggcagaaatatacttatatcttaatttatagtttgtaagtttatactgttttctaaaagtaataaatcatttcatgaaaaat

SEQ ID NO: 30547 - DNA, 326 bp, Homo sapiens
gacccattgtgtcctgttagcttcctcggttatgtggacatgcttggtgtagcctatgaagccccttcgctggccactggttatggtgcatacttggctcaggtaagtagtaagtctagaggtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctaga

SEQ ID NO: 30548 - DNA, 429 bp, Homo sapiens
caatgctttatttgtaaatttagtgtttttttatttctactgtcaaatgatgtgccaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatgtaaaaaaaaaaaaaaaaaaaaaaa

SEQ ID NO: 30549 - DNA, 477 bp, Homo sapiens
  misc_feature 42: n = A,T,C or G
tatggccgggtgtcttcatatttctaaaataaatgaattaanaaatttaaattcttagatgcttatctctatcatagctcagaatgcaacttcaatacccccattcttttatatttccagatttcttttaattaagatataatgaacaaattaagttaaatgaagtctgtattttcatgcaaatatattagtattcattaatatacatttattctttgcaaatagattttagttatattagctcttaaattgttgaataaattattattgaattttattattaaattattaaaatgaaaattataaaattagcactgtaaaataatatgtaaaggacttggaatgttaaaaataaccattcatcattttgctttatattacatctaatatttcctgaaacattttgtaatacccacatggaaagtggagaaagagaaaccttgtgctttttataaaacattgccaaggagaataatg

SEQ ID NO: 30550 - DNA, 483 bp, Homo sapiens
  misc_feature 7, 30, 32: n = A,T,C or G
attgacnaagctggaagaaattaaggagantncagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaagcctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaaga

SEQ ID NO: 30551 - DNA, 416 bp, Homo sapiens
  misc_feature 31: n = A,T,C or G
gaggccttgaggcagccagcgcaggggcttntgctgagggggcaggcggagcttgaggaaaccgcagataagtctttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaagttgagagaaaggactacagagccccgaattaataccaatagaagggcaatgcttttagattaaaatgaaggtgacttaaacagcttaaagtttagtttaaaagttg

SEQ ID NO: 30552 - DNA, 107 bp, Homo sapiens
catggccgtgggcacctgtggtcccagctttcaggaggctgaggctgcagtgagctgagattgcgtcactgcactccagcctgggcaacagagcaagactccatctc

SEQ ID NO: 30553 - DNA, 402 bp, Homo sapiens
  misc_feature 6, 32, 40: n = A,T,C or G
gcagtnagtgtgagcatttaagaagcatcctntgccaagnaccaaaaggaaagaagaaaaagggccaaaagccaaaatgaaactgatggtacttgttttcaccattgggctaactttgccgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccat

SEQ ID NO: 30554 - DNA, 200 bp, Homo sapiens
ttctgctgagggggcaggcggagcttgaggaaaccgcggataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcccgaaaaa

SEQ ID NO: 30555 - DNA, 169 bp, Homo sapiens
  misc_feature 30: n = A,T,C or G
agtctcgggtatgctgttgtgaaattgaanctgtaaaagtagatggttgaaagtactggtatgttgctctgtatggtaagaactaattctgttacgtcatgtacataattactaatcacttttcttcccctttacagcacaaataaagtttgagttctaaactcaaaaa

SEQ ID NO: 30556 - DNA, 335 bp, Homo sapiens
  misc_feature 9, 32: n = A,T,C or G
gggcacggnactgttggaggagagttagcctnagtataggctctgcccagatgccatcacatccctgatactgtgtatgctttgaagcaccttccctgagaagggaagaggggatctttggactaggttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattac

SEQ ID NO: 30557 - DNA, 219 bp, Homo sapiens
  misc_feature 26, 217, 219: n = A,T,C or G
attcacacattaatttgatcacaagnaaattttaaagaaatttaaacattttcagaaaaggctacttcaaggtgtcatgacagctttggaccaaacattaatgttctatatgactttgggcaagtcagtcatgtttattagacttaataacccaggtaacgttagctgttggagggttttttaaaaaacgttttattttgaaaaaacttcaaacttnan

SEQ ID NO: 30558 - DNA, 451 bp, Homo sapiens
  misc_feature 31: n = A,T,C or G
gaattccacagcgtgctctgcggggtcactnccactttgttagtgatgtggttgtctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccaga

SEQ ID NO: 30559 - DNA, 312 bp, Homo sapiens
  misc_feature 5, 32, 34, 39, 46, 51, 64, 152: n = A,T,C or G
cgatnttagaggtctaaggggagcccaggacngncactngtaaaancaggnctatggacgatgnaaatgagatcgagacggaatggtaccctggagtcaagggagaagagaattttaagaaagcagttcaccatggcacatgtacacctatntaacaaacctgcacattctgcacatgtaccccagaacttaaagtaaaattaaaataataaaaataaaaaaaggctgggtatggtggctcacgcccgcctgtaatcccagcacttttgggaggctaaggcaggcagatcacttgaggtcaggagttcaaga

SEQ ID NO: 30560 - DNA, 350 bp, Homo sapiens
  misc_feature 340: n = A,T,C or G
gtcctcaagctttttgggtatgagatggcttaattcaaggtgaccatcaaatacatgtgggattcacagtcgggaaggttccagctgatgggagacgacttgccagagagcgcatctgagtccacagaagagtcagactcagaagatgatgactgaaagggactcgggactgaaggtctcctggaagcttctgggtctcactggaccatcaggactgctgccgcccctctggagagagcagctttttatttgtctgtagacagggaacatgatgggcactgacctcctgtaaagaataaaactgtgggccgggcgcggtggctcacgcctggaatcccancactttggga

SEQ ID NO: 30561 - DNA, 315 bp, Homo sapiens
  misc_feature 30: n = A,T,C or G
catcacgggtgacacatctggagactacangtaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatat

SEQ ID NO: 30562 - DNA, 277 bp, Homo sapiens
  misc_feature 31: n = A,T,C or G
ggactggtcccccaggaccctctgtaagtanatcactgtaaacgtgtcttcatttactctagccaaaaggcctggcttctgataggaaactggtaagaaactcttcatgaaaacacatcactaatattcgctattactctcctggtctgaagtcagcttttctgaaccattaaggtatttcatcacaagtcatattttataatatcagtttaagaggcttttattcatgtgaacaccagtcccctttcaggggcatggtctttttgaaaaaaaaaac

SEQ ID NO: 30563 - DNA, 349 bp, Homo sapiens
  misc_feature 11, 33: n = A,T,C or G
aattacctagnaaggattgcttttttaaaaatntactgcgggttggaaagggatatttaatctttgagaaactattttagaaaatatgtttgtagaacaattatttttgaaaaagatttaaagcaataacaagaaggaaggcgagaggagcagaacattttggtctagggtggtttctttttaaaccattttttcttgttaatttacagttaaacctaggggacaatccggattggccctcccccttttgtaaataacccaggaaatgtaataaattcattatcttagggtgatctgccctgccaatcagactttggggagatggcgatttgattacagacgttcgggg

SEQ ID NO: 30564 - DNA, 359 bp, Homo sapiens
gggacccacgttagaagggacagaacatgccatcaaggaaattgtcaaagaagaagctgatgagtactttgtcatagtcttgagtgatgcaaatctgtcacgatatggaatacatcctgctaagtttgctcaaatcctcacaagagaccctcaagtaaatgcttttgccatttttattggctctttaggtgatcaagcaaccaggcttcagagaactttaccagctggtcggtctttcgttgccatggataccaaggatatccctcagattttacaacagatcttcacctccaccatgttgtcgagtgtctaagaagtgcccttcatcaccctgatgacaccaggatttgaaataagac

SEQ ID NO: 30565 - DNA, 242 bp, Homo sapiens
  misc_feature 32: n = A,T,C or G
acaggcaacagaaaagcaaataccacatgttntcacttataagtgggaggtaaatgatgagaacacatggtcacatagtggggaataacacatacggggtcccttcaaggttggagggtgggaggatcaggaaaaataactaatgggtaccaggcttaatacctgggtgatgaaataatctgtacaacaaacccccatgacacaagtttacctatgtaataaacctgcgcatatactccaaa

SEQ ID NO: 30566 - DNA, 150 bp, Homo sapiens
ctgctttgcagcttactgcttccctgggctagccataacggggttctgggcaggtcagactcttcagcaagacagtgtattaatagtgtgaattagatacactgatgacctgctctgcctagttaagaaactgaattaatcagcagttac

SEQ ID NO: 30567 - DNA, 316 bp, Homo sapiens
  misc_feature 5, 6, 30, 31, 264, 272, 281, 311, 315: n = A,T,C or G
agagnntaggtgttgaggtaaatgttaatnntataccttgccgggcgcggtggctcacacctgtaatcccagcactttgtgaggctgaggcgggcagttcacgaggtcaggagatcgagactatcctggccaacacggtgaggccccctctctactaaagatataaaaaattagccgtgcatggttgcggggcgcctgtggtcccggctactcaggaggctgaggcaggagaatgatgtgaacccgggaggcggaccttgccgngagccaanaccacgtanttgcactccagcctgggtgacaaaaaaaanactnt

SEQ ID NO: 30568 - DNA, 234 bp, Homo sapiens
  misc_feature 2, 3, 4, 10, 16, 27: n = A,T,C or G
annncccccnttaggngggtgcaccgnggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactat

SEQ ID NO: 30569 - DNA, 150 bp, Homo sapiens
  misc_feature 20: n = A,T,C or G
ggggagaattgagaatagtnaggcctatcagtctcacagaatcacccctctacctttgatattccacttagctgtagagtctatctgtttgtccatctgctgaaatgagaaaagaaaaatttatgcactgatttaaaacaaaccaaaaaa

SEQ ID NO: 30570 - DNA, 332 bp, Homo sapiens
  misc_feature 21, 32: n = A,T,C or G
ggtcacccaagtctgcccagnaagctcagaangctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaacga

SEQ ID NO: 30571 - DNA, 404 bp, Homo sapiens
  misc_feature 6: n = A,T,C or G
ggaggncattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatccagatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattg

SEQ ID NO: 30572 - DNA, 326 bp, Homo sapiens
  misc_feature 16, 22: n = A,T,C or G
ctaaagctgggagacngaaacnatgcagaccgccggggcattattcatttctccagctctgccttcctacagcaacttcccactccaggtggccaggacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatg

SEQ ID NO: 30573 - DNA, 366 bp, Homo sapiens
  misc_feature 32: n = A,T,C or G
ggagttccgccttccttagtaaagggacaatnaagggaaggcgaaccccgcgtccaaaacatggccaatgaaaggacgctggaatggaagccaggaatcctgctgtggtggagaggcatagactcatgagtccaccacaatcggatacttgcttctttttaacagccctatcagccgagagaaataatgactcctgaatcatttgacagtaaaaaagttaaaatgatgtctcaatggcgctgcatcatgccagacgcgcgtggatgatttgaagatattagcctaacaagatggaagcaggtttaaaattttacataagaagttacctttttcagttgtgttgatgttcctttcagctggtcctat

SEQ ID NO: 30574 - DNA, 411 bp, Homo sapiens
  misc_feature 33: n = A,T,C or G
gaaggccttgaggcagcccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttta

SEQ ID NO: 30575 - DNA, 172 bp, Homo sapiens
gctattctgtgtcaaacacctctgtattttttaaaacatcaattgatattaaaaatgaaaagattattggaaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 30576 - DNA, 373 bp, Homo sapiens
gttgccatgcttgtctatttcacttttgggaagacaagattaaaggctgctcttgataaaaaacagggacagaaaggctcttgcagttgctttacatacctgtggcctgagtcgtttgtgccaaggagagtgtaatccacttccagctgacgcccccagctctctgcgacggattgaggtttgtgtgcaggacgtctggcatacggcccatgaggactttgtcgtgtaaagcaaatgggaacgttgaggcatgtagaggttttgaagcagagtgtcggtccttccttccatacgcctgaaacgcataatccggggctttttgagagcaaaaacatagtcagaaatgtgccctgagggagaatgtactattttg

SEQ ID NO: 30577 - DNA, 348 bp, Homo sapiens
  misc_feature 16, 296, 300: n = A,T,C or G
caagaacgctttcttnaacctgtcgctctctgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggncacngctaacatttattaaacttcatgttagttgatgaaacagctggaggga

SEQ ID NO: 30578 - DNA, 223 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcaaa

SEQ ID NO: 30579 - DNA, 225 bp, Homo sapiens
atgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctg

SEQ ID NO: 30580 - DNA, 402 bp, Homo sapiens
  misc_feature 7: n = A,T,C or G
aataaancctatgttgcttccttgttggggctcctccacaatgctcccaacacctgtgacccctaggaagacagggagcaaggtggatctggccaggagtcacaggatatacacccattctggagctttcctctgttgttctagaagatgttatttgattagttggggctgggagcaggggatatatgattttgtggaaaaggtatcagataatcaaatcaggtctgcctctgctatagccagtgtgctgctgcattaaaagggaacaaaaggaaggtgcaacgtaagagcagacacaacctgagatgcccttgagatttaggagaacaggagggcgccctttctgttgtgacctgactcttaaaagaaatcttctaaaagaattctttaatttggtaatga

SEQ ID NO: 30581 - DNA, 125 bp, Homo sapiens
  misc_feature 36: n = A,T,C or G
attgacagtgatgtgctgcataacgacattttagtnaattgactgaaatgagatagacacacagacacacacacagacacaaatacccccacagacacccacacagaaacacacaaaaaaaaaaa

SEQ ID NO: 30582 - DNA, 175 bp, Homo sapiens
agtggaaaactggaagacagaagtacgggaagggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtac

SEQ ID NO: 30583 - DNA, 424 bp, Homo sapiens
  misc_feature 12, 22, 37, 53, 119, 122, 202, 215, 241, 270, 321: n = A,T,C or G
taaagctggganaaagaaaccnatgcagaccgccggngcattattcatttctncagctctgccttcctacagcaacttcccactccaggtggccaggacgggagttccatgaccagtgntgnctcccgggacattgacacagcagccaagtttattggtgctggggcagccacagttggtgtggctggttcaggggctggcnttggaaccgtgtntggcagcttgatcattggctatgccnggaacccgtctctcaagcagcagctcttntcctatgccattcttggctttgccctgtctgaggccatggggctttttctngtttgatggtgggccttcctcatgctgtggggcatgggaaggctccatgggggggggggacccgggggctgggggctgctggaggctggcacaccggtgggtg

SEQ ID NO: 30584 - DNA, 192 bp, Homo sapiens
gttggaggaggaggcattgttgagcgtctctgaaagggtacagaatttctttgtagggtgataaaaatgtcctacaatgagacacaggtgatggctgtacaactttgtggatatattaaacaacaatgaattatgtattttaaaatagtgtatattaattacatctcaataaagccgatattaaataagaaa

SEQ ID NO: 30585 - DNA, 403 bp, Homo sapiens
  misc_feature 32: n = A,T,C or G
catctcacgttctaaacattagtgtttagtcnctgaatatgcaaattattttctttcatgctacataccatatattccgggtacaggaagagctaaaacgtgtctctgagcataccgtcacaggtcggtctttatttaaaacacaggaaggagacctgtgtgtctggtgagggcaaggtcctgtctggtctctggtgacacttgagagggccacggtgggtagaggagacagtgacttctactgtgaatcaatttagaattgttaatccaaatcccaccatcataacacacccttctgcatgcctggaacttctgcatgcaccagatacgttgaattaggtcatctcagtacccattggtcccttttcctttttaacttcccctgtccccacctttgcttttg

SEQ ID NO: 30586 - DNA, 437 bp, Homo sapiens
  misc_feature 6, 32: n = A,T,C or G
gagaantgtcagcttcaccacgctcttgcttnctaatgctctatacaaagagggctgactatatttcttgaagtggtgtaaaaacttagagattttataagagaaccaggggctcccttcacctctcctggtccctcaggtcacatatgaaagcatttttacaagataggaactggaattcttcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatcttta

SEQ ID NO: 30587 - DNA, 189 bp, Homo sapiens
  misc_feature 16, 18, 32, 42, 67, 79, 83, 86, 91, 136, 145, 171, 182: n = A,T,C or G
acccaggaggaaaatncngaaaggagccaganaaaccgatcnaccgcgagtaagacatgcccactgntagcatacaggntctncancaccnataacggccggcacgcaccgaatggacggagttctcccggggaantgtacacgnccagcgagttgctgatctacacttgnatggatgcaangcttgaa

SEQ ID NO: 30588 - DNA, 290 bp, Homo sapiens
  misc_feature 8, 33: n = A,T,C or G
gaaggccnttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggaga

SEQ ID NO: 30589 - DNA, 263 bp, Homo sapiens
  misc_feature 30, 31, 260, 261: n = A,T,C or G
attgaccacatgctgtggcttgagcaaccnnagaatatcgccacttgtattgctctccggccctaccccaaggaagaagtgggccagtatttgaagaagttccgattgttcaagtaactgctgctttgatgtgtttgaatacgcaggccacccattccaaagcatcatgtgttccttgcagtgtcagcttgctcccgtctttcagttgtgacaatttcttgagggttaagcacatgttcatattaaagttgtcattaatnntt

SEQ ID NO: 30590 - DNA, 346 bp, Homo sapiens
  misc_feature 6, 33: n = A,T,C or G
gtttgngtcaggatctaaaggatggaaaagttngtgggcagctgaggactggagggaagaatgctcctgacaagaggacagcgtgtgtgagggcccagcagtgggaaagctaggctagtccaagatgttgaaagaaggcccatcctgatttatatcgggggctgtcccaaaatgaggcagcattcctttacagacgaatgtcttcgagaccatgttctgtatcctaagtgcactggagcccagtggagggtgttaagggggtagtgacatgactcaggtccgcatttctgaaagcttaatctggctgcgattggaaaattcattgagggagagtaagaatggaagc

SEQ ID NO: 30591 - DNA, 393 bp, Homo sapiens
  misc_feature 22: n = A,T,C or G
acttccttgaatataaaaaatntgccagtttttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttttttaatatgcttataacctagttaaagaaaggaaaaga

SEQ ID NO: 30592 - DNA, 426 bp, Homo sapiens
  misc_feature 31, 32: n = A,T,C or G
aatctactgttagtgaatttgtcttatgtannaggatatttcagggaaatattttccgaaatctatttagagtctctttaacacagtgtcccattgaaattttaatttttagagaatttatgaatcactgtttcaagaaccagattggaaagacgatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggaaga

SEQ ID NO: 30593 - DNA, 106 bp, Homo sapiens
  misc_feature 17, 22: n = A,T,C or G
agaaaggtcttgcctgnccacnctctctaaaatgcacccaccgccaaacacttccatcttttaatctcttaccgagttttatggtttttttttcacgagaatttat

SEQ ID NO: 30594 - DNA, 114 bp, Homo sapiens
gagggtgaggcaggagaattgcttgagctcaggaggcggaggttgtagagagccgagaatgcactactgcactccagcctgggtgacaaagtgagactctgtcccaaaaaaaaa

SEQ ID NO: 30595 - DNA, 312 bp, Homo sapiens
  misc_feature 15, 23: n = A,T,C or G
tactaaccttttgcngccctccncattttctgagatacttgaaaacatattttgacatttacatgttttgccagtacccattatgttcctgctttattaaagccattttattcacctgacagattaagattagaatattttaaaagttgaattttgaaagcaaaagtttgttctactgcagtagttcgcaagtgctggtctttgtatgactgcatctgagtcacttaagaaggctttttaaactctagattcctgggctgtaatccttggagattctgatgacttaccatttttggcatccattctttagaa

SEQ ID NO: 30596 - DNA, 130 bp, Homo sapiens
tcataacggatcagaaatacagattttgatagcaaagcgacgttagtcgtgagctcttgtgaggaaagtcattggctttatcctctttagagttagactgttggggtgggtataaaagatggggtctgta

SEQ ID NO: 30597 - DNA, 238 bp, Homo sapiens
  misc_feature 224, 225: n = A,T,C or G
gaaatctaattgacaggattattggaaatttgttataatgaatgaaacattttgtcctataagattcatatttacttcttatacatttgataaagtaaggcatggttgtggttaatctggtttatttttgttccacaagttaaataaatcataaaacttgaaaaaaaaaaaaaaaaaaaaaaaaaaaaaaaaaaaaaaaaaaaaaaaaaaaaaaaaaaaaaaannaaaaaaaaaaaaa

SEQ ID NO: 30598 - DNA, 403 bp, Homo sapiens
gttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagaga

SEQ ID NO: 30599 - DNA, 439 bp, Homo sapiens
  misc_feature 5, 30: n = A,T,C or G
ggacncattcagactttaaagcgttaatantttatcaactataattattgtaataaaaatagtaataattattaatatcgagaaaaattaagtacatatggaaaattctgtattctcatataaaaatgatttgtactcttcacacagtaaccttccttggggagtaattttcataattaaaacaaatgaattatactataattctgtattttaaacaaatattatagatagtgtaagatgtaagcctgggatatgctgaaaattcaaaatctggttgttcctctgaatcctaagggaggaaaataatgtatattttgccatttaaaaaaaaattatatttaaatattaactaggctttaattctataattcccttatttttaaagaataataatctcaaacacatttactattatttgcaaagttcattacagtgaaga

SEQ ID NO: 30600 - DNA, 422 bp, Homo sapiens
catataaaccttatcagtcttctgcccagaataatggctcaccagcccaggagataacaggaagtgacacattcgaaggcctgcaacaacaatttttaggagctaatgagaactctgcagaaaatatgcagattattcaacttcaggttcttaacaaagcaaaagagagacaactggagaacttaattgaaaagttaaatgaaagtgaacgtcaaattcgatatctgaatcaccagcttgtaataataaaagatgaaaaggatggtttgactctcagccttcgagaatcacagaaactctttcagaatggaaaagaaagagagatacagcttgaagctcaaataaaagcactggagactcagatacaagcattaaaagtcaatgaagaacagatgatcaagaagtccagaacaactgaaatg

SEQ ID NO: 30601 - DNA, 400 bp, Homo sapiens
  misc_feature 3, 31, 33, 399: n = A,T,C or G
acnacccacccaactatctataaacctagtntntggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacnc

SEQ ID NO: 30602 - DNA, 226 bp, Homo sapiens
aaccgtggaatactcaactgcagtctagatgtgggctagatgtacacatggcaacatcatgggtgtcaaaatcatagtgttgagtgaaaaacagtaagaaacagattggagacctaatgccatttatataaattaaaaatgcacacacacacaatataatacatattttgcacaaacatttagaatggcaccttggaggggaggaaaatgagaatgggaactagag

SEQ ID NO: 30603 - DNA, 217 bp, Homo sapiens
  misc_feature 16: n = A,T,C or G
gttcctccttttcttnccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttaagaaaaaaaaaagga

SEQ ID NO: 30604 - DNA, 319 bp, Homo sapiens
  misc_feature 33, 34: n = A,T,C or G
aagggtcctgaaggaaaagtagaagaagcccannggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagc

SEQ ID NO: 30605 - DNA, 436 bp, Homo sapiens
  misc_feature 6, 7, 33, 37: n = A,T,C or G
ataganngtagaactatattttcccccaatttnaatnatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtacgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaa

SEQ ID NO: 30606 - DNA, 436 bp, Homo sapiens
  misc_feature 8, 17, 28, 29: n = A,T,C or G
tttctttngcgccaggnaacccccggtnntttatggcccgggcatttcctatagctcaaaatcttaaaatctatggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaagatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaaga

SEQ ID NO: 30607 - DNA, 308 bp, Homo sapiens
gtatagaaaaattagaaccctcatacattgctggtgggagcataaaatggtttagccactgtgggaagtagtttggcagttcctcaaaaagttaaacagaattaccatatgacccagcagttccactccttggtatatagaattgaaaacgcaactcaagtaagtatgtgtgtgagcatgttcatagtagcattattcacaataaccgaatgacagaaacagcccagatgtctatcaagtgatgagtggataaaccagttgtagcatatacatacagtgaaatattattcatccatgaaagtgaatga

SEQ ID NO: 30608 - DNA, 299 bp, Homo sapiens
  misc_feature 31, 32, 57: n = A,T,C or G
ggaaatcctgaagtggaaatgatgagctganntgcaatgagttgaaatgagatgaancgatgaaatgatgagatgaaatgatgagatgagatgtgatgaaatgatgatatgaaatgatgacataaaatgagatgaaatgagatgtaatgatggaatgagatgagatgaaatgagatgaaatgatagatgagataaaatgatgatatgaaatgatgagatgaatgatgagatgatgagatgaatgatgaaatgaaatgatgagatgagatgatgaaatgaaatggtgagatgaaatgatg

SEQ ID NO: 30609 - DNA, 132 bp, Homo sapiens
aataaacaacaatgcccatgttggtcctctgccttggacctgtgacattctggactatttctgtgtttatttgtggccgagtgtaacaaccatataataaatcacctcttccgctgttttagctgaagaatt

SEQ ID NO: 30610 - DNA, 119 bp, Homo sapiens
  misc_feature 31: n = A,T,C or G
atctagaacttcatcgccctctgatcgccgntcacctctgagacccaccttgctcataaacaaaatgcccatgttggtcctctgccctggacctgtgacattctggactatttctgtgt

SEQ ID NO: 30611 - DNA, 262 bp, Homo sapiens
tgctaagtggaatttggcctctatgcccagagataggaaagcattggagggttttgcacagagggctatctgaccattttggctattctgtgaaagtaaactatagagggtagaaacagggaaagtcaggaggttattgctgtaatccaggtgggcaatgatgttggcttttagacagtggggataacagtaaaggtggtgagaaatgggtttttattggcttagtgtggggtttgagaaaaaggagtcagggatgacttaa

SEQ ID NO: 30612 - DNA, 347 bp, Homo sapiens
  misc_feature 7, 58: n = A,T,C or G
aattagnctaaaatttattttctactgtatcttttcaaatgttaaaatattgtttaanatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaa

SEQ ID NO: 30613 - DNA, 316 bp, Homo sapiens
aaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgc

SEQ ID NO: 30614 - DNA, 156 bp, Homo sapiens
  misc_feature 30, 31, 149, 150: n = A,T,C or G
aggttctttgcatatacatgcttgaattanngcagcttagtatcaaggatcagaaaattatggcccacaggccaaatctggcctgccacctgtttttgtgtagcctgcaaactaagaatgttttttatttttattttttagtggttgcnnaaaaaa

SEQ ID NO: 30615 - DNA, 394 bp, Homo sapiens
gaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctct

SEQ ID NO: 30616 - DNA, 258 bp, Homo sapiens
catcaatagggtgaagaggaggcaacaagaaagaaatatttgtgtccatgtttgattcatattgtattgaaatggtcccttgatattagttgccctgatttcttatttttttattggcaaacctctgggtcctattttataacaagcagaaagtaactgccaagcttcatttcaaattggctccaaagtatgagtcaagataatttacatatcaggtaaagtagacacacttaacataatttgaatagtttagattat

SEQ ID NO: 30617 - DNA, 343 bp, Homo sapiens
gtactaagataaattcttctgccctgggatcctgttgatcggtgaccctacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggctgcagggtcctctgcctaggaaaaccagagacctttgttcacttgtttatctgccaaccttccctccactattgtcctatgaccctgccaaatccccctccgcgagaaacacccaagaatga

SEQ ID NO: 30618 - DNA, 320 bp, Homo sapiens
  misc_feature 26: n = A,T,C or G
taacgtaattttaatagcttaagacnttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaaga

SEQ ID NO: 30619 - DNA, 244 bp, Homo sapiens
gatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaac

SEQ ID NO: 30620 - DNA, 212 bp, Homo sapiens
  misc_feature 30, 148, 187: n = A,T,C or G
atgtcttagacaaatactcatgtgtatggncaaaaaactcgaggactgtatttgtgactaattgtataacaggttattttagtttctgttctgtggaaagtgtaaagcattccaacaaagggttttaatgtagatttttttttttgcnccccatgctgttgattgctaaatgtaacagtctgatcgngacgctgaataaatgtctttttttt

SEQ ID NO: 30621 - DNA, 288 bp, Homo sapiens
atcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagaga

SEQ ID NO: 30622 - DNA, 422 bp, Homo sapiens
  misc_feature 5: n = A,T,C or G
ggagngaaaccttattttttaactgtgctttggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctga

SEQ ID NO: 30623 - DNA, 337 bp, Homo sapiens
  misc_feature 28, 30, 288: n = A,T,C or G
aggacaaggaaggcatccctcctgaccntngtaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctgnaagatggacgcaccctgtctgactacaacatccagaaagagtccaccct

SEQ ID NO: 30624 - DNA, 348 bp, Homo sapiens
  misc_feature 31, 337: n = A,T,C or G
gtttgctgtctgatctgttaagttacatgtntatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgntggttttcttg

SEQ ID NO: 30625 - DNA, 185 bp, Homo sapiens
  misc_feature 5, 29, 31: n = A,T,C or G
ggggnaactgcgaggcgaaggtgaccggntnccgagcatttcagatctgctcggtagacctggtgcaccaccaccatgttggctgcaaggctggtgtgtctccggacactaccttctagggtttttccacccagctttcaccaaggcctcccctgttgggaagaattccatcacgaaaaatcaat

SEQ ID NO: 30626 - DNA, 432 bp, Homo sapiens
  misc_feature 14: n = A,T,C or G
gaacaaccttagcnaaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttg

SEQ ID NO: 30627 - DNA, 174 bp, Homo sapiens
caaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctg

SEQ ID NO: 30628 - DNA, 409 bp, Homo sapiens
  misc_feature 6: n = A,T,C or G
agaatntcttttactgtaatcccttacaataaagccttaatagccattttctatgtaatatgcaaaagtagattagcacaatgcacaattttcttttgttaaaaatcaaattcaaagatttaattcttcctatgaattctaaagttcggcaaaccaactcatcataaaatccaaataatcttgtaacctatttatctagtgattcatctccgattctgttgaaaaagcataacataaatgttggtgagtctagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatac

SEQ ID NO: 30629 - DNA, 133 bp, Homo sapiens
  misc_feature 31: n = A,T,C or G
ggccgccgcctagcagccgacttagaaactngtgcggaccaggggaatccgactgtttaattaaaacaaagcatcgcgaaggcccgcggcgggtgttgacgcgatgtgatttctgcccagtgctctgaatgac

SEQ ID NO: 30630 - DNA, 433 bp, Homo sapiens
aaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatat

SEQ ID NO: 30631 - DNA, 466 bp, Homo sapiens
  misc_feature 12, 30, 463: n = A,T,C or G
catgcctaaaanagttgttcagcaaccctnagcctactcttgctttattttcaccagagtaaaataaagaaacaaacaccaagtttgtattactgcttttcagattatttattcactccaaagcttcttaaaatacctatgcagcagaatatcttcccttttctgacccacacatatatctatttttatatggcttggccattccaaagttgagggatagggatggacgcgggtatcagactgaatatcgtctccacttattagataaatctttgtggaaaatttagtggaagagctatgttgaattgagtagggtcattaaatactggaatgaggaattgcagcgtttgaacttgtccagacagtgatcctaaagtagcctgtcttccagctttttgcttttcctttgatggctaccaggattctcttataaaggaggaaagtgagaagagcagatctctgnggt

SEQ ID NO: 30632 - DNA, 363 bp, Homo sapiens
  misc_feature 32, 156, 280, 361: n = A,T,C or G
gacctccgaatcttcttagttattttcaggtncaaggttttcagcttcagaaaggacagaggtctccatggttccattttgaagatttttgggtggctactgcttgtttaccagcagtttggtatagaagcccaagacagtccatgtgtggttcangtattgacctaatagcagaataaatttggaccaaacagaagtccttttctttgtcactgtgtttgattaactatcctggatatgctttattctctaaaaacttcatttttgaaaataccatggntattaaacaactagtctttgtgcgtgattaggacataaacaggaatctcacccacttttaaacctttccaagaaataactntt

SEQ ID NO: 30633 - DNA, 432 bp, Homo sapiens
  misc_feature 6, 7: n = A,T,C or G
aggacnngtgacactaacagttactatgactgtattccatatgttcaaaaagttaagtagacttctcaattacttagatctaaatataaaaaactcctaggtgtgaaaaccacagtgtgtgaggagaaagcttcattgcataagactgaagatagattataaattgcagaaaagtaatcccagcactttgggatgccaaagtggaaggattgcttgaggtcaggagttcaatacctgcctagaaatagagtgagaccctgactctaaagaaaacatttgaaaaattagccaggtatggtggtgcatacccttaatcccaggtactcaggaggctgaggtgggaacattgcttgaggccaggaagtcaaggctgcagtgaaccatgattctgtcactgcactccagcctgggcaacagagcaagaccttttct

SEQ ID NO: 30634 - DNA, 293 bp, Homo sapiens
  misc_feature 29, 30: n = A,T,C or G
ggttgcccttggtctcggggtcgctgtanncgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaaccccagtgaagaagttacctggaagtaaagactggctagattatcgaatgttcacattttaaagttctgagagaaataaaaacatgaagaatct

SEQ ID NO: 30635 - DNA, 416 bp, Homo sapiens
  misc_feature 6, 406: n = A,T,C or G
gaaaangtgtgtgtttttttgttgttgttgtttgtttgtttgtttttaaaaaaaacttcaaaaagttggggctgggtgttgaattgaagtcagggttgtgtctctcagaaggttgtgacgttttgggggaaacaccccaaatatagcggatagcttgtttaagaataaaactgaaggaaaaacttagacccattcttaactatttttctcacaaaatccccaatcgttattgggtttttctcagagatttaaagaaaagccctccctttatctgagctctgtcgtctcatgggggcctcttgggcatgcatttttctagacaccttggacacttggtgtggaaacaaatgtttggaaatgatctatatctggatgctttcctcataaatatatatggatatatagnaaactacttt

SEQ ID NO: 30636 - DNA, 363 bp, Homo sapiens
  misc_feature 33: n = A,T,C or G
aaggtcccaacagcttaataatagcagtttgtncagtgtcctgcatatatcactatctttcccttaaaaatttccagcattggctgagcatggtgactcacgcctgtaatcccagcactttgggaggctgaggcaggtggatcacctcaggtcaggaatttgagaccagcctgactaacatgatgaaaccccgtctctactaaaaatacaaaattagctgggcatggtggcacatgcctgtaatcccagctactcaggaggctgaggcaggagaattgcttgaacccgggaggcggaggttgcagtgagccgacatcgtgtcagtgcactccagcctgggcaacaagagcaaaacttcatcct

SEQ ID NO: 30637 - DNA, 421 bp, Homo sapiens
atagccagtgtgctgctgcattaaaagggtacaaaaggaaggtgcaacgtaagagcagacacaacctgagatgcccttgagatttaggagaacaggagggcgccctttctgttgtgacctgactcttaaaagaaatcttctaaaagaattctttaatttggtaatgagttgaagtccagggtaatggaagctctagggcagagaacaaaagaattgcaaaatgtattcagcaccaaacaatgctaaaccaagaaacatccaatcacaaaactaggaagtttggcaagaagtggttagagaaatctctgggcttttccatgggcagggtcgacagactctcttttcagtgatttctggctctgagaaacctctttactcactagaaaagaactttatttaaatggccaattttgttcctcac

SEQ ID NO: 30638 - DNA, 109 bp, Homo sapiens
tgatgcccgcaccatccgctaccccgatcccctcatcaaggtgaatgataccattcagattgatttggagactggcaagattactgatttcatcaagttcgacactggt

SEQ ID NO: 30639 - DNA, 181 bp, Homo sapiens
  misc_feature 31: n = A,T,C or G
gatttgcctagggtcattcagtaagtccgtnatggagctagaacttgttcttgtcagtttttcgttctagtcttccctttcatggaggcaagaataaccattatgaaacagttagataatcataaaaatcagcatacaataaaagacttaaatgtcacgagaaaaattcaaaacctttagc

SEQ ID NO: 30640 - DNA, 490 bp, Homo sapiens
  misc_feature 23, 30, 32: n = A,T,C or G
gatgcctaacttttccgcaaagnagatggntnatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaactt

SEQ ID NO: 30641 - DNA, 327 bp, Homo sapiens
  misc_feature 16, 21, 176, 179, 181, 239, 297: n = A,T,C or G
ctaaagctgggagacngaaancatgcagaccgccggggcattattcatttctccagctctgccttcctacagcaacttcccactccaggtggccaggacgggagttccagaccagtgttgtctcccgggacattgacacagcagccaagtttattggtgctggggcagccacaggnggngnggctggttcaggggctggcattggaaccgtgtttggcagcttgatcattggctatgcnaggaacccgtctctcaagcagcagctcttctcctatgccattcttggctttgccctgnctgaggccatggggctttttctgtttgatg

SEQ ID NO: 30642 - DNA, 320 bp, Homo sapiens
  misc_feature 24: n = A,T,C or G
atttgcttgattgctttttatgtnttatttgcaacttgatatagttgacctgtaagtggtttcatcattaaattaaatttatgattggttggatagaatacaccaataagtttatgagatttgctttttttagaaaaactatcatacttatttgtgcctgttttggcagtaagaagttattatgttgttttttttgcatttagccataattatggacttgttaaacaattggttggtagaatggatttagataaaagagtaaatatgggctttcttattacttttttttctgattaaaaaaccaaactatgggtattggg

SEQ ID NO: 30643 - DNA, 326 bp, Homo sapiens
tataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagaggggccatatgatgtggtggttctaccaggaggtaatctgggcgcacagaatttatctgagtctgctgctgtgaaggagatactgaaggagcaggaaaaccggaagggcctgatagccgccat

SEQ ID NO: 30644 - DNA, 438 bp, Homo sapiens
  misc_feature 4, 31, 33, 34, 64, 77, 137, 287, 368, 402, 411, 417: n = A,T,C or G
gagnccatcaaccccagcacactggtttgantnntgttaagacttgacagtggaactacattantacacagcgccanaatgtatattaaggtgtggctttaggagcagtgggagggtaccatgcagaaaggttagtntcatcagatagcatcttatacgagtaatatgcctgctatttgaagtgtaattgagaaggaaaattttagcgtgctcactgacctgcctgtagccccagtgacagctaggatgtgcatctctccagccatcaagagactgagtcaagttgntccttaagtcagaacagcagactcagctctgacattctgattcgaatgacactgttcaggaatcggaatcctgtcgattanactggacagcttgtggcaagtgaatttgcctgtnacaagccanattttntaaaatttatattggaaatat

SEQ ID NO: 30645 - DNA, 486 bp, Homo sapiens
  misc_feature 6: n = A,T,C or G
caatangataagcattatacaaagatatatcttgtacctgcaatgtacctagcagtatgctttggatgatacaaaataacaaacattctcaatttctataaacctccctgtctagatgagaagacaaaactgatagtgaatgaaatagagattaattaagtgctaaaattaaggtaaattgatgccaagtgcagtaagaattcagagaaaagagaaatctttatggatcatattatacattactagaaaaagtaggacttgaactaggactagaataatggatgagattctattgaccagtgagaagataatgaacagttctaaatataagaaattgctcaaaccaggagtctcatgcatcttttattctaaactttccccccaacttgttaatttggcagcaggaaaaaaaaatgaatgagatggccacaaatgccgtaaacctgaggaatcatagataaatgaaggaattgaagggatttaaga

SEQ ID NO: 30646 - DNA, 419 bp, Homo sapiens
gaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggta

SEQ ID NO: 30647 - DNA, 232 bp, Homo sapiens
  misc_feature 24: n = A,T,C or G
agtttcccatggataactgaaacntgggaagtggaactgtggataaggcaggactactgtaactatgacatcaatggtaggaacctgaagcataattctgctgtagtggattttttcaaaagaaactcatgaatgaaaaataatttattagatataagaaaggatgcatttgtatctcaaactttacttattctggaaataaatgaaaagccaacacctattacataccgac

SEQ ID NO: 30648 - DNA, 382 bp, Homo sapiens
  misc_feature 251: n = A,T,C or G
gagtatggaaaaagagcatccgtgctggcatggtcttggtgacagcagtgggagataagtgataaacagggagattgacaaacaagtaaatatgttgaggataatggagtcaggtttctcatggtcataaaagagagctccaaatatggaaaggggaaaagtacagtcaaccctttgtagttagattggaatcagaagttttcaatatacagctagacagaggagtaaatatagatgtgaatgcgtatgcncctatatccatacattatgtattccccatctctgtccattgtgaggacctgggagcagtgataccttaatataatagcaatggtcacacctagtaccatcctccactgaaagaaatcagggctttgtggag

SEQ ID NO: 30649 - DNA, 226 bp, Homo sapiens
  misc_feature 14, 23: n = A,T,C or G
ctctcccggcaggngcgatgccncagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtga

SEQ ID NO: 30650 - DNA, 381 bp, Homo sapiens
  misc_feature 56: n = A,T,C or G
ggctgcctttaccacagaactgttgtattatgggttctttgtgacctgtatcttgngaaaccagtcctgctgaattcctgtatcagcaggggctcctcctgcaaatgcagaggctccccaagagagcacaagggggctcaatcagtacttgtgggatgaaggcatggtggtgctccaagagggacgacggatgattcctcggaagccttctctgctgctgatccatagtaaagccccttgagtgccttccttatctccttcaccatcatcttggtaaccaccaacgtgttgactggagtgagttcctggaaagagctccagagctaaggtctgctgcactagggagggaggtcaccctcccagagtgctgggatctcttct

SEQ ID NO: 30651 - DNA, 393 bp, Homo sapiens
  misc_feature 30, 55, 294: n = A,T,C or G
ggaactatctatttaatataaaaataatgntgtaattgaggaatagagaaagaangacatagaacaaataaccaaattaagtaaattctacattatcagtaattatattaaatataaacagattaagcactccagttaaaaggccaaagatgttgataaagtagattagaaaacagaatccaactacacagggtctacaagagagacactttagactcaaagacacaaaaaggttgaaagtaaacgggtggaaaagatgcattacacaaaaagtaaccaaaagacacctactgnggctgtactaatatgactaatatcaaaggacgcttgaagaaaaacattattactaaaggcggaagacatttatagtatatcattatgtagtcatagatg

SEQ ID NO: 30652 - DNA, 150 bp, Homo sapiens
  misc_feature 146, 148: n = A,T,C or G
caagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcantntc

SEQ ID NO: 30653 - DNA, 203 bp, Homo sapiens
ggatcctttgtccattgtttttaaagagacagagtctcgctcttgctctgttgcacaggctggagtggagcagcgcgaccatggttcactgcagcctcctgggctgaggcaggagaattgcttgaacctgggaggtagaggttgcagtgagctgagatcacaccactacactccagtctgggctacagagcgagaccccatct

SEQ ID NO: 30654 - DNA, 378 bp, Homo sapiens
  misc_feature 6, 55, 187: n = A,T,C or G
atagcnaggactaacccctataccttctgttaatgaattaactagaaataacttngcaaggagagccaaagctaagacccccgaaaccagacgagctacctaagaacagctaaaagagcacacccgtctatgtagcaaaatagtgggaagatttataggtagaggcgacaaacctaccgagcctggngatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaag

SEQ ID NO: 30655 - DNA, 126 bp, Homo sapiens
gcagtgagccaagatggcgcagtgtactccagcctgggtgacagagtgaaactccgtctcaaaaaaacaaaaattagccaggcatggtggcacacacctgtagtcccagctattcaggagggttga

SEQ ID NO: 30656 - DNA, 271 bp, Homo sapiens
cgtggagccaccgtgcaatgcccatctctgagaggcccacgcggtattcctcgtgccctgtgttagtgctttctgtataagggacagacagaactgggtttttttcctctgtctggttttagagtaaatgtaactaacttttattttccctttatgaaagatagaaattatttttatgtagtttccagactttatacaaaatttttgtaaaatgttctctggaaagttaactacaagaatgtaaatatgcttctaataaaataacaaggcc

SEQ ID NO: 30657 - DNA, 320 bp, Homo sapiens
  misc_feature 24, 242, 266: n = A,T,C or G
gctgagggggcaggcggagcttgnggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagtaaaaaatgtntttaaaagaaaattgagagaaaggactacagagcccccgaattaataccaatag

SEQ ID NO: 30658 - DNA, 186 bp, Homo sapiens
tcaacatggcaaaaccccatctctactaaaaatacagaattagctgggtgcggtggcaggtgcctgttgtcccagctacatgggaggctgaggcaggagatcacttgaacctgggaggcagaggttgcagtgagccaagattgtgccactgccctccagcctgggcaacagagtgagactgcccca

SEQ ID NO: 30659 - DNA, 422 bp, Homo sapiens
  misc_feature 6, 29, 30, 31: n = A,T,C or G
ctcacngaaaatgaccaggtgtggctccnnnttcccaatgccgagtcaaatggcctatactcctctgagtatgtccactcctctttctcaggattcctagtggctccaatgtgagtacaccccacagagctaatctaaatcttgtgctagaaaaagcattctctaactctaccccaccctacaaaatgcatatggaggtaggctgaaaagaatgtaatttttattttctgaaatacagatttgagctatcagaccaacaaaccttccccctgaaaagtgagcagcaacgtaaaaacgtatgtgaagcctctcttgaatttctagttagcaatcttaaggctctttaaggttttctccaatattaaaaaatatcaccaaagaagtcctgctatgttaaaaacaaacaacaaaaaacaaacatt

SEQ ID NO: 30660 - DNA, 126 bp, Homo sapiens
cgatgaagaacgcagctagctgcgagaattaatgtgaattgcaggacacattgatcatcgacacttcgaacgcacttgcggccccgggttcctcccggggctacgcctgtctgagcgtcgcttgcc

SEQ ID NO: 30661 - DNA, 111 bp, Homo sapiens
agttgataagaggaatttggtataattatggtgggtgattattttttatactgtatgtgccaaagctttactactgtggaaagacaactgttttaataaaagatttacatc

SEQ ID NO: 30662 - DNA, 500 bp, Homo sapiens
  misc_feature 456, 475, 479: n = A,T,C or G
gtttgaccccaaacctctgaacacggatgctttgactcatggtgtggtcagtgctgttggataactttgcgcacatgcttgtctggttttggtaattagggaatatgctttgcagggcaggaagctcacatttctttgtgtccccatggcatctggcacagcacttttcactccaaagacctgcatgactgtgtgttgcttgagaggtctgagcagctcatgttcactttgtgctgataacctggagacaggaaggaaaggaacttcttctcctgctgtaagggcaacatggcgatacacagcacatctcaaactctgtgcatcccagtctcctggaggacttgttaaaacaaatcgctgaacctacccaccagtttctgagccagtggttctgcatggggctggataatttgcacatctaccaagatcccagctggtcttggaccccactttgangatgactgtcgtactgggnaagnacaacccaaattcgaatccca

SEQ ID NO: 30663 - DNA, 287 bp, Homo sapiens
  misc_feature 23: n = A,T,C or G
agaaaaccctgaagttagaagtnggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtc

SEQ ID NO: 30664 - DNA, 309 bp, Homo sapiens
  misc_feature 7, 33, 308: n = A,T,C or G
gaatatnttgaattacaccgtaaacgctatgtntaccgtttggattaccatgagaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaanc

SEQ ID NO: 30665 - DNA, 338 bp, Homo sapiens
  misc_feature 7, 33: n = A,T,C or G
aaaggancggtggaaactatgacctatcctttnaaagataaacaacatgcatgtggatggctttgccaccaactagctgtgatcccaacctgttagatgggaaaaggaggtgccttcttggccaagtgaaagaaaggcttgctgtctgctctaagcccagggaaccaatggggaaagaataagctaaatgtgttaacgggattccaaattacttaaagcctttatgggaacacggtagattgtaggtaactagatagggttgccagatcagtttgatttgactttcagtataatttttcagtatatgttccaaaaattgcatgggatatgcttatact

SEQ ID NO: 30666 - DNA, 450 bp, Homo sapiens
  misc_feature 28, 31, 56, 447, 449: n = A,T,C or G
gacgcccggggcgggtgctgcttgctgnttnctctggggagtcgccatgcctacancacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctggtgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggnana

SEQ ID NO: 30667 - DNA, 219 bp, Homo sapiens
  misc_feature 18: n = A,T,C or G
tcgaggagagccggagtngggcacccaggagtttcctgtgtccagcgctgccggagccgcctgaggtgaccagcacccatgcagaaactacctagaagttgccaagctatcagtcaactcagcatacaaaaagaaacttaccattctaaggatcttagaagttgtatgccaggaaatgggatgaagaccaaatgtatatctcacaataaatattacagc

SEQ ID NO: 30668 - DNA, 340 bp, Homo sapiens
gaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgcagattctctg

SEQ ID NO: 30669 - DNA, 113 bp, Homo sapiens
  misc_feature 39, 62: n = A,T,C or G
gatacacaaatacttaccattgtgttatgcttgcctgcngtattcagtacagtaacatggcntacaggtttatagcctaggagaaacaggctatacaatatagtctaggtgtg

SEQ ID NO: 30670 - DNA, 360 bp, Homo sapiens
  misc_feature 29, 32, 57: n = A,T,C or G
gagaaccgcgtttggctgtgctgtgttgnttnatgaagttttaccatcaattcaagnaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctg

SEQ ID NO: 30671 - DNA, 100 bp, Homo sapiens
  misc_feature 23, 42, 71, 77, 82, 85, 89, 99: n = A,T,C or G
tgtttggggatgtgtgttgtggnctttgctttttttttttanactgttttaataaacatacaacacaagcnggcctngggtngcnggtncctattcagna

SEQ ID NO: 30672 - DNA, 354 bp, Homo sapiens
  misc_feature 30, 353: n = A,T,C or G
aaaccggatcaattaattcaccctccactnaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaaganc

SEQ ID NO: 30673 - DNA, 327 bp, Homo sapiens
  misc_feature 158, 176, 239: n = A,T,C or G
ctaaagctgggagactgaaacaatgcagaccgccggggcattattcatttctccagctctgccttcctacagcaacttcccactccaggtggccaggacgggagttccagaccagtgttgtctcccgggacattgacacagcagccaagtttattggngctggggcagccacagtnggtgtggctggttcaggggctggcattggaaccgtgtttggcagcttgatcattggctatgcnaggaacccgtctctcaagcagcagctcttctcctatgccattcttggctttgccctgtctgaggccatggggctttttctgtttgatg

SEQ ID NO: 30674 - DNA, 328 bp, Homo sapiens
ctaaagctgggagactgaaacaatgcagaccgccggggcattattcatttctccagctctgccttcctacagcaacttcccactccaggtggccaggacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgcccctgtctgaggccatggggctttttctgtttgatg

SEQ ID NO: 30675 - DNA, 310 bp, Homo sapiens
taacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttg

SEQ ID NO: 30676 - DNA, 441 bp, Homo sapiens
caagaacccggtatgtgcaggtgctgagcttttagcctctctgcagcccagggaaggcttactgggtgttaaccatgttctctgctaaatacccagcagcacttaaaatagtgctgccacatagtaggtgctcaataaatatttattgattaaatgaatgcatgaatgaatcaattaaccaagcaagcagtctggaatctctaagaaaaagggttcctgtgcagagtggtgttccacacaatacttaccaatgtttttgtgtaggttgcaaatctccaagaccatggggctgagtattttggaatgaatatcttacagtgagaacataattgaatgggctgctttatgacaaggtgagccctctgtcaatgagatgctcattcattcactaattcattgcaaagcatctgttcactggaaattggatgctatagtaagtac

SEQ ID NO: 30677 - DNA, 251 bp, Homo sapiens
gacttcagtttgcattttcctcaattctcgttaaatccttcattctaatggacattttattgtgaagaacctgttcatatcctgtgctcaactttgtattgaattatttttctctgaataatttttaggagttcttttattctagacatcaatcatttgtcagttttatatgttgcaaatatcttctagtctatcttgtgacttttctttttactttatggtattttgttgaataaagttttaatgtagcc

SEQ ID NO: 30678 - DNA, 374 bp, Homo sapiens
  misc_feature 6, 58: n = A,T,C or G
aatagnccatgagccttaatacatagctttcttttaagaaaggagcctttttttttcnctagcttcctggggtaaacttttctaaaagataaaatggaaagggactccaaactatgatagaatctgtgtgaatggttaagatgaatgttaaatactatgcttttttgtaagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaaga

SEQ ID NO: 30679 - DNA, 425 bp, Homo sapiens
  misc_feature 203: n = A,T,C or G
acaaatcttcatcccaggggtgactggaagacgcaaacttttacaagtgttttaaaaataaatatactatgtggttttagacacagtatgctgagtcagaggtgtcttagagaatgtttaaggttagacataaggcagaaagacagccagattgcctttaattcggaggcaatattcctaaactgtgtatcattatgtccttnggaatatggattcacttgaaacttaattaaataggcatatacataacatttcaaatacatacctgaaaaggcttagtagtgtttcattttcacacattgagcttgatattcaaaaaagaaaaagattgatgctcagtgaatcaaagcaaagtactttctaggtaaaagtgacaccatctcatccaatgtctctgaaagatctcagttgcacagtctttggat

SEQ ID NO: 30680 - DNA, 325 bp, Homo sapiens
  misc_feature 20, 21, 291, 297: n = A,T,C or G
gtgtccctgtgggtggacgnngttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggnatgcanatcttcgtgaagaccctgaccggcaaga

SEQ ID NO: 30681 - DNA, 128 bp, Homo sapiens
  misc_feature 128: n = A,T,C or G
gtcgatgaagaacgcagctagctgcgagaattaatgtgaattgcaggacacattgatcatcgacacttcgaacgcacttgcggccccgggttcctcccggggctacgcctgtctgagcgtcgctttcn

SEQ ID NO: 30682 - DNA, 214 bp, Homo sapiens
cagttgcagccctgctgttgcctgcctggacttggcccctgccacctcctgcctcaggcgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccc

SEQ ID NO: 30683 - DNA, 194 bp, Homo sapiens
  misc_feature 32, 33, 191: n = A,T,C or G
caaccctgtctctactaaaaatacaaaaattnnccgggcgtggtcctgcgcacctgtaatcccagctgctcaggaggctgaggcaggagaattgctcggacctggcaggcagagtttgcagtgagccaagattgcaccactgcactccagcctgggtgacagagcaagactttgtctcaaaaaaaaccaanatt

SEQ ID NO: 30684 - DNA, 284 bp, Homo sapiens
caaatgtctggcattttgtgagcaggtggttgggatgggtaggaggttgtctgggattgagaaacacaaaacactgctctaaatttgttaccaaggggtgaatcattttgcggggaatatttcatccagatgctctatagtcttttccatacaactgttgacattcaattaaagaaatatgaaacaggactaaggaaacaacaacagacagtagtagcagatgcataaatgaccagttattaggaattaacggatatacatatttaaataactataacaaacat

SEQ ID NO: 30685 - DNA, 170 bp, Homo sapiens
  misc_feature 32: n = A,T,C or G
aatcttaaacaatttgtgtagaagtccacagnacatctttcaaccaccttttaggctgcatatggattgccaagtcagcatatgaggaattaaagacattgttttttaaaaaaaaaatcatttagatgcacttttttgtgtgttctttaaataaatccaaaaaaaatgtg

SEQ ID NO: 30686 - DNA, 471 bp, Homo sapiens
aaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagttt

SEQ ID NO: 30687 - DNA, 471 bp, Homo sapiens
  misc_feature 11, 37: n = A,T,C or G
agagaaatttnggaaaggcttatgtggaattccaagnattatataaccaaaacatatccagatgacacctacaggttatccagactactactcagattgccagctttaagactgatgaatgctaccatcactgaggaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtattttttattttagcttcccttaagaattttttgaagtgactgggcaggcagcagaaattaaatgaatttttcttcctgattcctttaaatgaatatga

SEQ ID NO: 30688 - DNA, 219 bp, Homo sapiens
  misc_feature 30, 80, 198: n = A,T,C or G
gcaggtcttcagcacgtgacccggtacccnagctctaagggaggtggcatcatcaaaggctcccctcgcctgcttggcancaggggaatcttgcgtctacggggcctagaggcctgggatctgggggagccacccctgggggcagagtgtctgccctggtgctgtatcttgccgccttttcacaccgtgtgtgacccnaagaaacagcctgaggcctgt

SEQ ID NO: 30689 - DNA, 182 bp, Homo sapiens
gtaattacaggggaagattgtttttgaaaatgtatattgccatgcttttggggtaagcagtaatgtgaaaagaaaaaagcattatgttattgtatgaaatataagtgttcagatttgttttgtctggggtgttgcctaagaataccctaaagctatggctgttactgcattgaaatcttttt

SEQ ID NO: 30690 - DNA, 220 bp, Homo sapiens
aatcatttggaaggaaacaatggtgacttggacaaggttgtcggagtagaggtggagagaactagattaagtgtacattttgaaggctgagctagcaagatttgttgttgattatgtagagagcataagagaattggagctcaaggataatgacaatgtatatagcctgagcatctgaaatgattggcatgcaatttactgagatggggaagacaagact

SEQ ID NO: 30691 - DNA, 155 bp, Homo sapiens
agtgaaatgaaattgaaataaaatcgaaatgagatgagatgaaatgatgagatgatgaaataaaatgatgaaatgatgaggtgatgagatgaaatgatgagatgaaatgatgagatgagatgagatgacatgaaataatgaaacgaaattgaaat

SEQ ID NO: 30692 - DNA, 472 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtg

SEQ ID NO: 30693 - DNA, 283 bp, Homo sapiens
  misc_feature 7, 279: n = A,T,C or G
gtaggcntcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagtttttttgttttcagaaatgagggcagctgttaattttttcactcatgtgaaacanaatg

SEQ ID NO: 30694 - DNA, 472 bp, Homo sapiens
ggaacaccacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttccacaatgagcttcgtgttgcccctgaagagcatcccaccctgctcacggaggcacccctgaaccccaaggccaaccgggagaaaatgactcaaattatgtttgagactttcaatgtcccagtcatgtat

SEQ ID NO: 30695 - DNA, 221 bp, Homo sapiens
  misc_feature 7, 10, 24, 30, 37, 44, 49, 56, 57, 62, 64, 88, 217: n = A,T,C or G
gtatggnggnaggctgaaagatgnaatttntattttntgaaatncagcntttgagnnatcanancaacaaaccttcccgctgaaaagngagccgcaacgtaaaaacgtatgtgaagcctctcttgaatttctagttagcaatcttaaggctctttaaggttttctccaatattaaaaaatatcaccaaagaagtcctgctatgttaaaaacaaacancact

SEQ ID NO: 30696 - DNA, 472 bp, Homo sapiens
gtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatccagtcagggaaagagccggaagtacgacagttcttcttcttgctcgcagtttgccacacagtcatggtggataggactgatggtcagctcaactaccaggcagcctctcccgatgaaggtgccctggtaaacgctgccaggaactttggctttgccttcctcgccaggacccagaacaccatcaccatcagtgaactg

SEQ ID NO: 30697 - DNA, 476 bp, Homo sapiens
cgtgttggaaagtggcccaggtagattccttgaaggacaaagcacggaagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactatt

SEQ ID NO: 30698 - DNA, 470 bp, Homo sapiens
  misc_feature 4: n = A,T,C or G
gctngattttattctggcgtgaaggagtaatttgatggaattactgattttcaaaagaattagttggtgtgattttgaaaaattttacagtgggcaacaccatttttgttttggctaatacataggttctcctctcagcaattttcaggtcatcagaagaaagaaaggatgttgggctgcatagaactgaatactccactgctcttacaaaaactttgctgttatactgttaggaggtgcgaactcaagagcctaaagtagatgggaggggtctaaaaggagtggttggtcattcaaagaataagttcctttgttatcactatttgtcatagaagagtaacacttcctttactctgtaaagaaaaatgaggtagcataggagaggaaattacaagtatacctttcagtgcaggatgggaggaagtaaaagtgtttgaatatggaactaaaagtttatctcaggtcttctt

SEQ ID NO: 30699 - DNA, 172 bp, Homo sapiens
ggttcctccctgggctatgttttatttacttttgaagactttttctccaggtttttgtaggttttggcattaattttgaccacattttacctaaaggaaggacaagatcagcagggaacaaacttgtggtaaaatttgctgagtgtctatactgtgctgagaatgaactgtt

SEQ ID NO: 30700 - DNA, 477 bp, Homo sapiens
  misc_feature 16: n = A,T,C or G
gtagatgttattgatnagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccaca

SEQ ID NO: 30701 - DNA, 446 bp, Homo sapiens
catgtattgatttccctacaaacactcagcttggttcatgtagattcttgaaattgcactaaactctcaatgtaaatgattgttgtctttttattgatcaacacatcagctctgtcacataaaattatttaaatcctgagatggccaagaagaacacaattccatcattccagccagtaaactagcatgtaggagagaattttaatgtctgttcatggattcaaagttttttcattaataagatatggaaaagtgtaactttctttcatttatttatgtatttattctttttttgagacaggttctcactctattgcccaggctagagtatagtggtgcaattgtagctcactgcagtcttgaccttctgaggctggaggattgcttgaacacaggagttcaagatcagcctggacaacatagagaggcccaacatagaccctcta

SEQ ID NO: 30702 - DNA, 467 bp, Homo sapiens
gggacctaaggagtcgcagttgtgaacaggttagagttacttgttattggtaaatagccactatggagactaaggaccagaagaaacacagaaagaaaaacggtggacccaaagctgcaaagaaaaagaagtggcatctgcaggatctccagctaggagactaagaaaatgcccagaagagaaatgccaatgcttttgcagttcagtctgctgtgtggatgtctcgatcctttcacaggactctggatttgaagacacaaaagcatcatattccagtggttgatggaactccactagagccgccaccaataccggtagtggtgacggggcctccaaagttggaaagagcactttgatataatgcctcattcggaacttcacctggcagaagttcaccgagatcagaggccctgtgacgatcgtgtcaggtaaaaagcgcagactcaccattattgaatgtgggggtg

SEQ ID NO: 30703 - DNA, 392 bp, Homo sapiens
agatgagtagatgggaaggggtgcagcttttgtggcatacctattaaaaagagttgtcaaattgtccctttggtcccagaggatttttcaggtaatggtaatgatgataataagattcagatgtgtgggagatggcatttctgctgtacaggattgtgaaggggaaggtaggaaaagagatccttaatctcatggaagttgaagatttgtatagaaatttaattccttaaaagtcaaatctgtgtattggtggaggtcagcaaaatgacagaatgggacttcccagtgcttgtcttcacacagaaacataaattgaacaactattcttgcacaaaaatactttaataaaagctaaggaaaccaggtgagagatgaccgcacctggatgtagc

SEQ ID NO: 30704 - DNA, 472 bp, Homo sapiens
gataaggtagagagaaaggcaatgtttcaattttgttccaaaactatacccaattgctgtaaactttaagaggaataaaaggaagctccttaactttggaaaacaaaacaaaaagaatcagtaatgttcaaacctaaagccataaaatatcataatccttaatcagttgatgcccatgtaattcttattctgcttgttgagttcacagttttatgagtccagctttttccattggaattattaaaatttttatccagtccaactggataatctcaaagtcattagcagaggtctatatttcagggtagcctgtcagaagctttttatttttttcatgaaccttcttgaagacagaacacttgcaaatgtctttcaggagaagcatcagagtaaaacaatttactgtggacaacaagacttaaaatggccatggttaaaaatcttatggagagttcacaataatgatgcaatc

SEQ ID NO: 30705 - DNA, 464 bp, Homo sapiens
acttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccctacgatcctcctggagagaagatggtagcagcaaaagt

SEQ ID NO: 30706 - DNA, 159 bp, Homo sapiens
ggagtctgaggctctttccaacgctgtaaaaaaggacagaggctgttccctatggcagaaggcaaccacagaaaaaagccacttaaggtgttggaatccctgggcaaagatttcctcactggtgttttggataacttagtggaacaaaatgtactgaac

SEQ ID NO: 30707 - DNA, 472 bp, Homo sapiens
atccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattgcatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggt

SEQ ID NO: 30708 - DNA, 363 bp, Homo sapiens
gaacatggaataaaacaactgttcatttaagatttctatgtctgtcacaaatggcttttcaagtttcacatgtcaaaattgataggttatcaaggaaaagtaaaaagaaggcattcactttttacagtatacacaattttaataacaaaacttgcctgtacactgctctttatgttaccctcccccctcccaaaacaccctgcataatagtattttcttcccaccctcaacccatctgcccacctcccacccaaaaagaaaaatggctcttgaaggtgattgaacacaatgtatttggactgtactttgagtttccagtctcagtgttgataggaaggttcaccaaacattccatatatcaga

SEQ ID NO: 30709 - DNA, 276 bp, Homo sapiens
atttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacatac

SEQ ID NO: 30710 - DNA, 268 bp, Homo sapiens
agaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggg

SEQ ID NO: 30711 - DNA, 469 bp, Homo sapiens
ggcgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcaggagaagaaatgagccctccctcggcgaagcctccagcaggccacaccagctgtttcccacctactgtgcagtcaccttagatgttcagaagccgcttcctctccactgaagagctatgagatacgcacaatacttgctgttcacgttatgactctcatgcaagc

SEQ ID NO: 30712 - DNA, 399 bp, Homo sapiens
  misc_feature 398: n = A,T,C or G
gggagtcattctcttctgcttaaaaaatttaaaatatttttgaagtcttagattttttctgtattaaaaaagtaatcgttattttttgtttaaaacataaattaaaacatagaaatgtgccaggcatggtggctcacgcctgtaatcccagcgctttgggaggcgaaggcgggcagatcacctgagatcgggagtttgagaccggcctgaccaacatgggtgaaactctgtctctattagaaatgcagggttggccgggcgtggtggcgcgtgcctgtaatcccagctacttgggaggctgaggcaggagaatcgcttgggcccgggaggtggaaggttgccggtgagctaagatctcagcattacactccggcttgggcaacaagagcgaaattccnt

SEQ ID NO: 30713 - DNA, 153 bp, Homo sapiens
caagagcaattactactcgttctgggcagaccttatccaaagtctggtacaactgtccttagactgatgagcaaaggaggagtcaactaatgaagaaatgaataataaattttgacactgaaaaacattttattaataaagaatattgactag

SEQ ID NO: 30714 - DNA, 470 bp, Homo sapiens
  misc_feature 403, 405, 429, 455, 468: n = A,T,C or G
ggaagaacgaggggacgtaacggaggcaggttggagccgctgccgtcgccatgacccgcggtaaccagcgtgagctcgcccgccggaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcggggtccctttttgtgcttccttccccccaggtagcctntntccccctgggccactcccgggggngaaggggggttaccccttccaagtgntttttattcctgngg

SEQ ID NO: 30715 - DNA, 474 bp, Homo sapiens
  misc_feature 207, 230, 295, 311, 428, 473: n = A,T,C or G
ggaagaaacgaggggacgtaacggcaggcaggttggagccgctgccgtcgccatgacccgcggtaaccagcgtgagctcgcccgccggaagaatatgaaaaagcagagcgactcggttaagggaaagcgccgagatgacgggctttctgctgccgccccgcaagcagagggactcggagatcatgcagccagaagcagaaaaaggcnaacgagaagaaggaggaacccanagtagcctttgtggctttagtgtccaaccctcttgcccttcgcctgtgtgcctggagccaagtcncaccacgctcgcgttncctcctgtagtgctcacaggtcccagcaccgatggcattccctttgccctgagtctgcagcgggtcccttttgtgcttccttccccccaggtagcctctctccccctgggcactccnggggggaagggggttacccctttccaagtgtttttttattcctgng

SEQ ID NO: 30716 - DNA, 472 bp, Homo sapiens
  misc_feature 409: n = A,T,C or G
gcactgagtggtcaaaatacatttctgggcccctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtnttttttgttacaaatcttctgaaaaaaaacaaaacaatgtgaaacattaaaattaaaaggcat

SEQ ID NO: 30717 - DNA, 223 bp, Homo sapiens; identical to SEQ ID NO: 29680

SEQ ID NO: 30718 - DNA, 255 bp, Homo sapiens
  misc_feature 38: n = A,T,C or G
atgatcatttaccttgaaaaccctaggactcctccagnaaagtgcctagaactgataaaagaattcaatagagtttacggatacaagagtaaagtacacaaatcagtagctcttctatacaccaacagctaccaagtggagaatcaaatcaagaactcaaccccttttaaaatagctgcaaaaaataaataaataaaataaaatacttaggaatatacctaaccaaggagtcaaaagacctctacaaggaaaagc

SEQ ID NO: 30719 - DNA, 273 bp, Homo sapiens
atactatgaatgataactaatggccaattgctgcaagttgtgcactcaagaatgacacattagccattcatttaaccagagggaagaaagaagaggcccatttaatcaatatgcagcaacaggagatggaaactctttctatgaagagatggatacataggggggttcattgtacttttatacttttgtataataattatatataagtatatatttatataattgtaatatataattctgtataatttttaataaaaaactttaaaatttaga

SEQ ID NO: 30720 - DNA, 469 bp, Homo sapiens
ggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagcttggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaat

SEQ ID NO: 30721 - DNA, 479 bp, Homo sapiens
  misc_feature 366, 452, 460: n = A,T,C or G
ggtgggtgggggaagctgagggctgaggaccaagggctaaagctgggagactgaaaaaatgcagaccgccggggcattattcatttctccagctctgccttcctacagcaacttcccactccaggtggccaggacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgcccctgtctgaggccatggggcttttctgtttgatgggncgcctttcctcatcctcttcgccatgtgaggctccatggggggtcaccgggcctgttgctactgcaacttccacaccattcttggngctggggngtgttaagcttttaccatt

SEQ ID NO: 30722 - DNA, 481 bp, Homo sapiens
  misc_feature 274, 348, 368, 471: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtaccatgaggaaggaaaagataaaaggtttctaaaacatgacggaggttgagatgaancttcttcatggagtaaaaaatgtatttaaaagaaaattgagagaaaggactacagagccccgaattaataccantagaagggcaatgcttttanattaaaatgaaggtgacttaaacagcttaaagtttagtttaaaagttgtaggtgattaaaataatttgaaggcgatcttttaaaaagagattaaaccgaaggngattaaaaga

SEQ ID NO: 30723 - DNA, 220 bp, Homo sapiens
  misc_feature 9, 17: n = A,T,C or G
aattcggcnttatggcnaggatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttc

SEQ ID NO: 30724 - DNA, 309 bp, Homo sapiens
ggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatgg

SEQ ID NO: 30725 - DNA, 465 bp, Homo sapiens
gagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttggaagatgatcttgtaaagggaaagttctagtttgtggggaaagacactccatccaagaagagaaaacttgatcctgaaattgt

SEQ ID NO: 30726 - DNA, 118 bp, Homo sapiens
atagcaatgaggttatgcaatttttcacagtgatagagaagttagtgagaacttgaggttgagttttgcttatttaggatgtttgattttcccatagaaccaacaaataaccaagagg

SEQ ID NO: 30727 - DNA, 390 bp, Homo sapiens
  misc_feature 24: n = A,T,C or G
atggccgggggaaagggagcaagnaaggagggaaggtgattggttgaatggaaatagagaagaaagagagggagggagggttagaaggaaggagaaacggaaggaagaggccaggtgtggtggctcatgccaatcccagcactttgggaggctgaggcaggcagatcatgaggtcaggagatagagactttcctggctaacatggtgaaaccccgtctctactaaaaatacaaaaaaattagctgggcgtggtggcaggtgcctgtagtcccagctacttgggaagctgaatcaggagaatggcatgaacccaggaggcagagcttgcagtgagctgagattgagccacttgcacctttagcctgggcaagagagtgagactccatctcc

SEQ ID NO: 30728 - DNA, 475 bp, Homo sapiens
atggccgggggacaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtg

SEQ ID NO: 30729 - DNA, 417 bp, Homo sapiens
aatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttg

SEQ ID NO: 30730 - DNA, 188 bp, Homo sapiens
attcttctgaatgttggcctggaaattctcaaaaaaatactgatccattatatgagttaagataatatacaaacaaacaggccggatgcagtggctcacgcctgtaatcccagcactttgggaggccaaggcaggcggatcaggaagtcaggagttcgagaccagcctggcgaaaccccgtgtctact

SEQ ID NO: 30731 - DNA, 107 bp, Homo sapiens
aagctggaataatattaatacacacaaagcacatgttgtaacttttattaggcttccttagaggtaagatgcaaatttgtccttagccagtgtatgatggtaaatat

SEQ ID NO: 30732 - DNA, 241 bp, Homo sapiens
  misc_feature 241: n = A,T,C or G
gggtgcggaggtcagggacaagatggtgccccggtgcaggtctctccgctcatcaagattacctaaaacctcgggcagaagaggagaggagggtagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtggtan

SEQ ID NO: 30733 - DNA, 480 bp, Homo sapiens
  misc_feature 2: n = A,T,C or G
cnttatggccgggaacaaaatggattccactgagccccctacagccgaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagacttggtgttctcaaacccggtatgggtggtcaccttttgctccagtcaacgttacaacggaagtaaaatctgtcgaaatgcaccatgaagctttgagtgaagctcttcctggggacaatt

SEQ ID NO: 30734 - DNA, 466 bp, Homo sapiens
  misc_feature 358, 372, 402: n = A,T,C or G
agagttaggatgaaggaaacatttcctcaattcctctcccagtcttagttcctcttatccttcccaaagcagctacttgttgaatctggtcagtatctggtgcacagttttatattttactatagatgtattcatgagctacacacgtattgtgttctttttcttttcttttcttgagatggaatctcgctctgccgccaggctggagtgcagtggcacgatctcggctcactgcaacctccttctcccgggttcaagcaattctctcgcctcagcctcccgagtagctgggattacaggcatgagccaccacgcccgaccatgtaccacattttctatatccagtctatcatttggngggcatttaagggnttgttccatgtctctgctattgtgaatggngctgcaatgaacataagcaggcatatgtctttataatagaacaatgtatattcctttgggggta

SEQ ID NO: 30735 - DNA, 305 bp, Homo sapiens
gaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaaaaaaatt

SEQ ID NO: 30736 - DNA, 288 bp, Homo sapiens
  misc_feature 15: n = A,T,C or G
gggtcagggacaagnatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgat

SEQ ID NO: 30737 - DNA, 320 bp, Homo sapiens
  misc_feature 8: n = A,T,C or G
ctcaaagnagatatacaaatggccaaaaaacatatgaaaataatgctcaactaatgatcagagaaatgcaaatcaaaaccacaatgtgatgccaccttactcctgcaagaatggccataattaaaaaaataaaaaagcagtagatgttggcgtgaacgtggtgatcagggaacacttctacactgctggcgggaatgtaaactagtacagccaagacggaaacagtgtggagattccttaaagagctaaaagtggaactaccatttgattcagcaatcacactactgagtatctacccagaggaaaatcaatcattacgc

SEQ ID NO: 30738 - DNA, 463 bp, Homo sapiens
gtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctacttttgagtgctgtctccatgtttgatgtatctgagcaggttgctccacaggtagctctaggagggctggcaacttagaggt

SEQ ID NO: 30739 - DNA, 240 bp, Homo sapiens
gttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaat

SEQ ID NO: 30740 - DNA, 428 bp, Homo sapiens
agggtaaaatttacaaaaaactgactcgttttaagaataccactgtgcccggccgtaagaattctttatatgttgtagatttagccttttccctggcacacttttgcaagtattgctaaaagatttcttttatgttttcttctacacatttggtagcttctcatctaaagttaaatcttcgatccatttcaagtacattttgtattcagagtgaggcacacgcctgggttcctttctgttctatgtggatatctaagcttggtacctttgttttgattaaataaatacaagggttttttttctggactttttgttctcttccattgatctgtgtttctgtctttatcccagtaccatcctgccttgataagaggtttaaagtaaatctgaaattaggaatataaagtcttgcaatcttcttactttac

SEQ ID NO: 30741 - DNA, 339 bp, Homo sapiens
  misc_feature 207, 210: n = A,T,C or G
cctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagnggnggggggcctagccctactagtctcaatctccaacacatatggcctagactacgtacataacctaaacctactccaatgctaaaactaatcggcccaacaattatattactaccactgacatgactttcc

SEQ ID NO: 30742 - DNA, 105 bp, Homo sapiens
  misc_feature 24: n = A,T,C or G
ggggaatcagggttcgattccggngaggagcctgagaaacggctaccacatccaaggaaggcagcaggcgcgcaaattacccactcccgacccggggaggtagtg

SEQ ID NO: 30743 - DNA, 345 bp, Homo sapiens
  misc_feature 4: n = A,T,C or G
gagnacgcaggatgactgaagcccgattctgggggttgttacggcacagttacagggccttcctcacacccatgtcttcagatacccaaggcctttaatacccaagtccttccaggattctgcacatctcattagcttcatattcccttaaaaaggcttagtcctggaaaagtcgaagaggtgaaaacctgcctggggaggctgctgaaggacgccaggaagaattcttatctccaaattcaatcctgcctcccagctagctgctggtgtttgaaattccaactctgaagtggtagtctggtatcttcttttaaaatgtggaagagagtaaacaaagttattcgc

SEQ ID NO: 30744 - DNA, 310 bp, Homo sapiens
  misc_feature 11, 29, 42, 43, 54: n = A,T,C or G
tatggcgcggnaactacatcccttggatnttgctgtattgtnncctaaattggnacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttg

SEQ ID NO: 30745 - DNA, 488 bp, Homo sapiens
  misc_feature 1, 264, 449, 450: n = A,T,C or G
nggcactgatatgtgagggaggcactaaggttggttgactgtgttttaaacttcagaattaattgagactgtgtgcagcattttaaaatcctggcttaggcgctcttagtctcaacttttgcctctacttactgtaagtttcatgaactcagagacaatgtctattttgtttatgactataccagtgcctagcatgattcctggcatgtaataagtactcagtaaacatttgttaaatgatttttttgaatatttacccactgncatcaaaattcatagttcttcttttttctgtgtgttaagcaggccagatttccttgagccatactctgtcgtcaaatactaaatcttagtctgcaaaaatgaagggtttggaagaacacacagatgtaaagaagaatttgaatatgtttctgttattgcttccacatataggtttatagacttgnnccctttattatacctgattatcatttctgaattatact

SEQ ID NO: 30746 - DNA, 342 bp, Homo sapiens
  misc_feature 31: n = A,T,C or G
aatctctggtagtacttgccatctggtgctntcttgtgctcttaaaaaaatgcaggccaggctgggcgtggtggctcatgcctgtaatcccagcattttggggggccgaggcaggtggatcatttgaggtcaggagttcaaaaccagcctgaccaacatggtgaaaccttgtctctactgaaaatacaaaaaaattagctgggcatggtggtacatgcctgtagtcccagatacttgggaggctgaggcagaagaattgcctgaacctgggaggcggaggttgcagtgagccgagatcataccactgcactccagcctaggcaacagagagcaactttgtgc

SEQ ID NO: 30747 - DNA, 139 bp, Homo sapiens
cactatctgccaaaataaactttattccctataacttaaaatgtgtatatatatataatagtttattatgtacagttaattctactgttttggctgcaataaaatcgattttgaaataaatgaaatgttgaaaatttac

SEQ ID NO: 30748 - DNA, 470 bp, Homo sapiens
  misc_feature 29: n = A,T,C or G
agctccagtctgaggaagagatattgaangaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacact

SEQ ID NO: 30749 - DNA, 461 bp, Homo sapiens
  misc_feature 23, 32, 34: n = A,T,C or G
gaagcaccctggcaacctcaagnaggccctgntnatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctggactgggcagactgcaaaataaaatctcgg

SEQ ID NO: 30750 - DNA, 500 bp, Homo sapiens
  misc_feature 2, 3, 45: n = A,T,C or G
tnnttacggccggggggtacctacggtacctgaaaacaacgatgncatggaaaacacttcccacttacctgttgttgctgctgtctgttttcgtgattcagcaagtttcatctcaagagctttcctgtaaaggccgctgctttgagtccttcgagagagggagggagtgtgacttgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaatt

SEQ ID NO: 30751 - DNA, 472 bp, Homo sapiens
  misc_feature 13, 17: n = A,T,C or G
gacaaccttagcnaacntttacccaaatttgtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagc

SEQ ID NO: 30752 - DNA, 461 bp, Homo sapiens
  misc_feature 5, 6, 30: n = A,T,C or G
gggcnnaggaactggcaaagatttcatganggcaccagaattaattgcaacaaaagcaaaaattgaaaaatggaatctaattaaacttaagagcatttgcaaagaaattatcaacagagtaaacagccagcctacagaaggggagaaaacatttgcaaactgtgcatctgacaaagttctaacattcagcatcaataaggaacttaaatttaaaagaaaaaaacaaccccattaaaaagtgggccaaagacatgaacagtcacttttcagaataagatgtacatgtgaccaacaagcatatgaaaaaaagttcaacattactgatcattagaaaaatgcaaatcaaaaccacaacaagatactgtctcacaccagtcaggatagctattattaaaaagtcaagaaataacagatgctggtgaggttgcaggagaagaaaaaaacacatatacactgttagt

SEQ ID NO: 30753 - DNA, 211 bp, Homo sapiens
  misc_feature 6, 14, 32, 65, 75, 183, 203: n = A,T,C or G
ggaaanggaagggntctaggccagtaatgttnctatttagaagacactcaaattacagtctgtgntatgtatgtntaccatttattcaatgctactgtgtatataatggaaaacttaagtccagtttgaaacatctagtctttctaggtgtttaaaagtgtacaacagcctgtccgcagtggngcatgcctgttatcccagcnctttggga

SEQ ID NO: 30754 - DNA, 304 bp, Homo sapiens
  misc_feature 15, 24, 161, 242: n = A,T,C or G
agggctaaagctggnagactgaanaaatgcagaccgccggggaattattcatttctccagctctgccttcctacagcaacttcccactccaggtggccaggacgggagtccagaccagtgttgtctcccgggacattgacacagcagccaagtttattggngctggggcagccacaggtggtgtggctggttcaggggctggcattggaaccgtgtttggcagcttgatcattggctatgcngggaacccgtctctcaagcagcagctcttctcctatgccattcttggctttgccctgtctga

SEQ ID NO: 30755 - DNA, 486 bp, Homo sapiens
  misc_feature 6, 33: n = A,T,C or G
agtcancaagtttgtgcttaagctggatgggtnaaagagaatcccatttcactaagtataaaagaggggattttagagaaggtctcagaagaaagagatgtgggggtttggtgaaactcaccagaggctgaaccctctccagcataacacagggattgggaggagaagggcggcattaggccagatgtatagcccagtgctgctctctctggacttgtttgctagctgagctcatccatttacataattttcagtgccatttctcagctaatgagtcctgaacttttgtcttgaggctagaattctccttcaaacagcagttttaacactcaacttctttcttgttttttccacttgtcaactcatgaacacctcaaccttgttacatccaaagccaaactcatggcttggagtggtaggtgatggctgtaatcccagtgctatgggaggcagaggtgggaggattacttgaggccaggagttgga

SEQ ID NO: 30756 - DNA, 205 bp, Homo sapiens
  misc_feature 29, 30: n = A,T,C or G
atttgcgacaatacttcctcagctggagnngatgaatgtaaaaattcctgaaaatatctacagaggcattcgtaatctcctggaaagctaccatgttcctgaattgattaaggatgctcacttgttggttgagagtaagaatttagactttcaaaaaactgtgcaaccttacatcatctgaattggagtccacacttgaaacacc

SEQ ID NO: 30757 - DNA, 177 bp, Homo sapiens
atggtccggggtcataccaaactatcaaatgtttccaccaggttaattgatatgaacaagttgtttgaagaggattgatcagacagtgttgtttgtagcaagagtaggtgtggaaagaggttagaggtagggaacaatgaccaggtgctgcataaaaagccaaggtggccttaaccc

SEQ ID NO: 30758 - DNA, 488 bp, Homo sapiens
tactgcattgaccccaaccaaggctgcaccttggacgccatgaaggttttctgcaacatggagactggcgagacttacgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagaccgttatcgagtaccggtcacagaagacctcacgcct

SEQ ID NO: 30759 - DNA, 266 bp, Homo sapiens
  misc_feature 7, 27, 35, 38: n = A,T,C or G
gaaagcnagtatcaaagtaaggaaagnaagaaggnttnagaaaagtaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttcgctgttgacatggatgaaattgaaaagta

SEQ ID NO: 30760 - DNA, 107 bp, Homo sapiens
gaagcatgccagaacagactggtgaaaagtaaaccttttcacctacaaaatttcacctgcaaaccttaaacctgcaaaattttcctttaataaaatttgcttgtttt

SEQ ID NO: 30761 - DNA, 450 bp, Homo sapiens
tgaggccggagaattgcttgaacccaggtagttggaggttgcagtgagctgagatcacaccactgcactctactagcctgggtgacagagtaagactcccatctcaatctcaaaaaaaaatagtcatgaattatgcaattattctaattgcatctgcacttacgaagtcagaggtctcctttttcagtccctctgatagtcccacctaagtgctgtcctgctcctgtgaacactttcctgtgcaaccaaacaggaggtgccaggttcccagaactctctaacattacagatctctgtccatctttactaaaaaaaggaaatgtgagggaaagaaggggaagaactctagcataaataatgtattaatataaatatctatattgattttcaccccccattcccctttgctaatagaaaagagtctagctatgatgtgtcccaaatttaaga

SEQ ID NO: 30762 - DNA, 189 bp, Homo sapiens
  misc_feature 189: n = A,T,C or G
ggaaacaatatgtatgtggtatatactcaaatgtatataattctatctatagatttatatatgtataccttctgtacagtagttccatcaaaatatgtaataattcacaccaattttattaaatgtatttgctttttcaaaatttaaattgagctgctatcaatattaaatgaagttatggcatctacn

SEQ ID NO: 30763 - DNA, 220 bp, Homo sapiens
  misc_feature 14: n = A,T,C or G
tatggccgggaacnacttgtatataaatctacaggtccaaatgagacacatcgaagttatttaaaagaactaatggaggtcctcttggtacctctgagaatgtacttcagtaaatcatgggtatcaggagaggtctccaaacacaggaaaattggggtacctaacttaaagaagggttggaaaggagcctcaaggaactgataccccaaaggctaatcca

SEQ ID NO: 30764 - DNA, 484 bp, Homo sapiens
ctggggggttttttgtgggatggggatggagttttgctctgtcgcccaggctggagtgaggtggtgcaagcttggctcactgcaacctccgcctcccttgttctagtgttcctcctgcctcagcctcccgagtagctgggattataggcatgtgccaccacacctggctcatttttgtatttttagtagagacggggtttcaccacgttgaccaggctggtcttgaacgcctgacctcaggtgatctgcctgtctcggcctcccaaagtgctcggattacagatgtgagccaccacgcccagccggctgaggtgtttttgatgttagctcatttacctggaatctggacctggcattgggtaaaaggcaaatgactttatgatcctttttgctttcaacaaaacaccctttccggatgggaactatgacaggatgagttttcttcaaccttgggccaggacgccccacgcacatggccaccctg

SEQ ID NO: 30765 - DNA, 351 bp, Homo sapiens
  misc_feature 7, 32, 347, 349, 350: n = A,T,C or G
gcatgangataaactgtatgagcttttttttngtaaggaaaatggggctgggcgcagtggctcacgcctggtaatctagcactttgggaggctgaggcgggtggatcacgaggtcaagagatcgagaccatcctggccaacatggtgaaaccccatctctactaaaaatagaaaaattagctctgtaggcccagctactcaggaggctgaggcaggagaatcgcttgaacttgggaggcagaggttgcagtgagccaaggtcgggccattgcactccagcctggtgatagaacaagactctgtctcaaaaaaagaaacaaacaaacaaaaaacaacaacaacaacancnnc

SEQ ID NO: 30766 - DNA, 494 bp, Homo sapiens
  misc_feature 27: n = A,T,C or G
ataccaaaaggaaaacaaaggatgttnttcagaaaaataaattaaagctgactcgagaacaggaagaactggaagaagctttagaagtggaacgacaggaaaatgaacaaagaagattatttatacaaaaagaaggacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttgggtatgtgtcctaaagaactttacattgaggagctgatatgtgggacttattgctg

SEQ ID NO: 30767 - DNA, 481 bp, Homo sapiens
  misc_feature 17, 31, 32: n = A,T,C or G
atatgccatggtaagcnagtagatggactgnntactttgcgcaatgggacattagttgcattccgaggtcattatttctggatgctaagtccattcagtccaccatctccagctcgcagaattactgaagtttggggtattccttcccccattgatactgtttttactaggtgcaacctgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgcttt

SEQ ID NO: 30768 - DNA, 296 bp, Homo sapiens
gttgggcactgttctagactttgagggatactatagtaaacaacaccttaagattcctcttcttacgaagcttacattttagtagggacaacagatattgttaacaaataaataagcaaaatctctgtaaagtaataagtgctataaaacaaaaaggtgtaattgatagagaaaatgatgagggagctgacttagtgaaattcactctgttgaagtgataacttgagctaagaggaagcaacctgtccaagatctgggaacagcattccagataggggaaacacgtggctgaaggg

SEQ ID NO: 30769 - DNA, 459 bp, Homo sapiens
  misc_feature 16, 71, 184, 277, 425, 439: n = A,T,C or G
tatggccgggtgaaanccgaggaacattgtgaatttgtaaattgacttctgttttctcaaaggccatgccnttgtaaattgttagtgttcgccaaaggacagccaagctttcttttaaaaagtgataaaagtcttattttaatatgctttaagctgaaagaaaaaaaaataagaaacaggcagngttttaaaaaccaacacagatttgcacaactgtttaagagtattgtttgaaatattttaattttcaatgttttgttgttgttgttttcttggnaatgcttcttttttgcagatgtggtcccaatttatagcaatcttctcaacagaagtaggcatggaaaagacttcttttcatactctcactataaagaaagctgcattgagaagaaaatggctgtcatttaaaggatggtttaactagngagattcctattgngggtatacaagggctcattg

SEQ ID NO: 30770 - DNA, 180 bp, Homo sapiens
  misc_feature 121, 169: n = A,T,C or G
agactcgaggtgtgcttaaggctttcttagagaacgttattcgagacgccgtcgcctatacggagcacgccaagcgcaaaactgtcacagccatggatgtagtatatgccctgaaacgtanggggcgcactctgtatggcttcggcggctgaatctaagaatacgcggnctcctgagaac

SEQ ID NO: 30771 - DNA, 375 bp, Homo sapiens
  misc_feature 6, 344, 361: n = A,T,C or G
caagcntgccattatgcttttcttaggcctaagaaatatgctattgtaatcctcatttgtttgtttcctgtgttttactctacataaccaaatttcataatgagacaaagtaggccatagggctgttgttaagctctccttcagcattctctaggcctatcatatctgtcacaaatatccaatttatttgacctcagtcatcatttttaactttaatacacagttttcccataagagctcaaatatctttgcatcatttcccactcctgctgtaaggataatagctataacaggaaaagatgccattttaagggttttctcatgaatactgcatttctgtttgngtctgtcctttttctgntctacaacctcttg

SEQ ID NO: 30772 - DNA, 309 bp, Homo sapiens
  misc_feature 178: n = A,T,C or G
tcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcaggntctcaatttcattttttatgtattgttttactcctttttattcatacgtaaaattttggattaatttgtgaaaatgtaattataagctgagaccggtggctctcttcttaaaagcaccatattaaatcctg

SEQ ID NO: 30773 - DNA, 447 bp, Homo sapiens
  misc_feature 116, 164, 181, 245, 401: n = A,T,C or G
tagggctaaagctgggagactgacaaaatgcagaccgccggggcattattcatttctccagctctgccttcctacagcaacttcccactccaggtggccaggacgggagttccagnaccagtgttgtctcccgggacattgacacagcagccaagtttattggngctggggcagccacagntggtgtggctggttcaggggctggcattggaaccgtgtttggcagcttgatcattggctatgcnaggaacccgtctctcaagcagcagctcttctcctatgccattcttggctttgccctgtctgaggccatggggcttttctgtttgatgggcgccttcctcatcctcttcgccatgtgaggctccatgggggggcaccggcctgttgctactgaactncacaccattcttgggctggggggggttaagctttaccattaaacca

SEQ ID NO: 30774 - DNA, 421 bp, Homo sapiens
  misc_feature 24: n = A,T,C or G
agtgagactgttaaaattatgagnctttaaacataccaggttagagtagagctaaattttaaatatgcaaagttaaattaacacaaaaagtaatgacaaaatgaagaaatagagttatttaattgcaaaattatactccaactgtggcctatgtcaaagtgttttagaaacccctgaaatgttaaaagcatagagcttgaaggaatatcagaagtcatatattaaatcctattaatattttacaatgaaatctatatagtctgatacaagttgatgtatgtatttgtggaggctggaggagggggaagagcagaagaacttctgaacggcttctgtttctagtatctgagaaactaagtctttatgaatatttctgcagatttttttgtggctgccttcacagaactaaaggtgttaaaga

SEQ ID NO: 30775 - DNA, 125 bp, Homo sapiens
gctgagggggcaggcggagcttgaggaaaccgcagataagtttttttctctttgaaagatagagattagtccacctccttaaaaaatatagccaataggttactaaagaatatggcttagcggtt

SEQ ID NO: 30776 - DNA, 376 bp, Homo sapiens
  misc_feature 58, 147: n = A,T,C or G
aaagaaccaggtgaagtgaaggtggaaacttttatcggagtgatgcatcgtctacaancacgaggagccaggagacagcaagaggcaaggaaggctctttctcagagccctcatagggagcaaggtcctgctacacctttatgtcangacttctaaactccagaacttggagagaggaaaataaatctattgtttaaagccacctggtttgtggtcccttgttagggcagtcctaagagagtaaaacagttaggtttttctggatttctagctcatattcaggtcattatcaggtattttcaggtttttatcaaagcgtttcaggtattatcagggagactgttaagatataatgtcatgtcaggaaataacacac

SEQ ID NO: 30777 - DNA, 414 bp, Homo sapiens
  misc_feature 30, 31: n = A,T,C or G
gtgtgcggtgttagtaacagctttcaatgnntggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcctaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaaga

SEQ ID NO: 30778 - DNA, 469 bp, Homo sapiens
  misc_feature 7, 33, 433: n = A,T,C or G
aatgaangcacatgtgggatcatgtagcacctnctttgacattcattctcaggtgtatgagtttctcctctgattttagatcacatttgtcctcatcactcggcatatggacattgatgttgacaacctttgattttagttttcgacgtatgagaaatcataccatgtttgaaattgcaggggtatatttcacggagcctgtgtttccttttctcagtgtatttctgtcatgttctaatccccagacacaaagtagaagccatcaaaacctacgctaatacaggcaggaggacagaggttgatacaaacactgcatgaatgtatggataactttgtcatagttacatatgagtgattatgtatcccttttgcttttcagtgtcttctcagaaaaaaccagccttgaaggtaatgaaactctcatttatattgngagctagtaaacgtatagcctatgaaacatacctta

SEQ ID NO: 30779 - DNA, 184 bp, Homo sapiens
aggtatggaatgttatgattacctaaagagatgtctctacctaatgagctcaagtgatcctcccacctcagcctaccaagtagccaggaccacaggcaagtgcaccaccatgactggctagttttgttttttggtttttggtttttggtttttggttttttttttttggggggggggggggttt

SEQ ID NO: 30780 - DNA, 190 bp, Homo sapiens
  misc_feature 6, 18, 20, 22, 28, 29, 31, 32, 37, 46, 51, 69, 81, 86, 94,153: n = A,T,C or G
gaatanctgacaacatgnanangtgggnnanntatanttggatgtngcatntttccatgtctcaactgncgcatttggtanctatntagaaacntcaaaaggtttaagcaagattatgattttattacacttgacttggtgtaagatggaggncagagctattttcaaaaatctagtagaattttgtctc

SEQ ID NO: 30781 - DNA, 468 bp, Homo sapiens
  misc_feature 3, 32: n = A,T,C or G
ggncgccagttggtctcgacacctggactttncgggttgtatttggaaacgcggagcgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacaggaataatgtacaagaaaaggactaaaagattggtcgtttttgatgctcgatgaatgctgggaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatg

SEQ ID NO: 30782 - DNA, 254 bp, Homo sapiens
  misc_feature 32, 98: n = A,T,C or G
atggcccgatttgattcatgagatctatactnttagaaaacgcttcaaagaaggcaaataacttcctgtggcccttcaaattgtcttctccacgaggnggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaatcg

SEQ ID NO: 30783 - DNA, 488 bp, Homo sapiens
  misc_feature 18, 42, 455: n = A,T,C or G
tatggccgggcaaatgcntatttgttactaaagctatatttntgataaaaaatattttaggataattgcctacagagggatttatttttatgatgctggaaatatgaaatgtattttaaaatttcactctggcatatgatttatctatcaccattactttttttaaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactaagcagtgtgctggacctaaaatactgactttagttagtatccttggatttttagattcccagtgtctaattccctgttataatttgcacaaacaaaacaaaatgtatgataatctttctccactgnctatatatattggatttttaattggaaagcttg

SEQ ID NO: 30784 - DNA, 477 bp, Homo sapiens
  misc_feature 6, 24, 396, 438, 463: n = A,T,C or G
acaggnctcttgtgattgaaaatnatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcnaggtgcctttactacatgtgtgatctgaaaaccctgcttggntctgagctgcgtctattgaattggnaaagtagaccaatg

SEQ ID NO: 30785 - DNA, 474 bp, Homo sapiens
  misc_feature 7: n = A,T,C or G
gttacanaaaaagtgctaatttttgctgtttaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgc

SEQ ID NO: 30786 - DNA, 154 bp, Homo sapiens
  misc_feature 154: n = A,T,C or G
gatgatgattcttgtagtatcaacagtgacccagaagccaagtgttttgctgtgcgttctctgggatgggtagagatggcagaagaggacctcgcccccggtaaaagtagtgttgcgggtcaacaactgcatcaggcaacttttcctactgttn

SEQ ID NO: 30787 - DNA, 248 bp, Homo sapiens
gaactgtcatttttaaaagctgcctactgggcccatagttgatagaactggttttctgttgataagatatttaaatcatttcttgtgtcttctattaaaaacaaattttgcaggccaggcaaggtggctcaggcccgtaatcctagcactttgggaggcaaggcagacagatcaccagaggtcaggagttcaagaccagcctggccaacatggtgaaacaccatctctactaaaaaatacagaaatta

SEQ ID NO: 30788 - DNA, 430 bp, Homo sapiens
tacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtgggggggaaga

SEQ ID NO: 30789 - DNA, 321 bp, Homo sapiens
  misc_feature 3, 32, 33: n = A,T,C or G
ggntcacactcaatctgcataaaaccggtgtnnggttaatgtacctctcagctcctgatacatttattatacagaaattatagaccggctgacttaactattgctaagaaacatgcttcttggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccct

SEQ ID NO: 30790 - DNA, 404 bp, Homo sapiens
  misc_feature 1, 9, 35, 393: n = A,T,C or G
naactaacntgtcggtgttaacaaaatggattctnctgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggnggtcacctttg

SEQ ID NO: 30791 - DNA, 342 bp, Homo sapiens
  misc_feature 34: n = A,T,C or G
aagggccaagatgaaaaattataaccaagcattntatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactagc

SEQ ID NO: 30792 - DNA, 100 bp, Homo sapiens
  misc_feature 10, 65, 80, 87: n = A,T,C or G
tacagactgnttctgtggcagatagatcccagcactttgggagtgtgaggcagggtggatcactngaagtcatgagttcnagaccancctgcccaacata

SEQ ID NO: 30793 - DNA, 157 bp, Homo sapiens
ctaaagctgggagactgaaacaatgcagaccgccggggcattattcatttctccagctctgccttcctacagcaacttcccactccaggtggccaggacgggagttccatgaccagtgttgtctcccgggacattgacacagcagccaagtttattg

SEQ ID NO: 30794 - DNA, 414 bp, Homo sapiens
  misc_feature 39: n = A,T,C or G
tatggccggggaaatcatttatgatgacattatgaaganttctaattgactgtcacatttttatagttaagataaccgtcataggaaataggatgatattatgaataactttatgccaataaaatgtaaaaatgtaagtgaaatagtcaaatttctagaaaaacttatgaaaatggatacaaaaaggaataaattatcagagtagtcctctattaagtagaaaccatatggaaaaataaaagaatcttcccacagcaaataccccaggtccagatacctttaccagtgaattttactaaatattttaggacaaaatatgtaattttacgtaaactttaccagaaagtagaaaaataagagacaatgtcacccatttgtgaggacaacataaacttgatgccaaaatctgacaag

SEQ ID NO: 30795 - DNA, 238 bp, Homo sapiens
tacgagtgcggcttcgaccctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactgaaccgagc

SEQ ID NO: 30796 - DNA, 498 bp, Homo sapiens
gtgtttagtatattgcaacatgagaaaacagatgtgacagccatttggtgaagtttaacattaggagcattctgaaaaactgaaaagctttgtatatctgcatactttatattatttgaattatgtccaaaatattcctaatatctttatttttctatatgtgtggctaatatctaaattacattttcttaatacataattcaaaaattgtgaaagtttattaaaatgtaatgctcatgaaaacttgttttcatgaaaggttatggaagaattagaaaaggtaaaacaagaaatggaagaaaagggcagcagcatgactgatggtgctcctttggtgaagattaaacagagcttaacaaaactgaagcaagaaactgtagagatggacattagaattggcattgtggacacacactactccaatcaaagctgaaggagaagtccaacatgactaggaacatgcatgccacagttattccagaaccagcaacaggcttt

SEQ ID NO: 30797 - DNA, 485 bp, Homo sapiens
  misc_feature 7, 55: n = A,T,C or G
acttgcncactttacttaccggtgtctgttctctgaatttaattatctatatagngagtatatttctctatttgaaactaaagttggagttatttaaattaaagatttggtttgctgacagatatcttattctctttcaggttcatgtctgtcttcatgcttaagatttggtatttccagtaacttgaacgagtgtaacctgctagcaacagttgattagacttttactgatttttctttgccccagaaacatatcagcccatgtttaaaggatgcaaatccaaataattcttatcttcattgcctaacgttatctagctccaggatactactggtcagtcctatgtgtttcctacctaacatgtccaaatcaaagcccagtgcaatgtcatctccagacttttcttactcccaattataggggggaaaaaaagtgtcactaaggctccaacttccagtaatggtagaatagcttgatcatcaac

SEQ ID NO: 30798 - DNA, 152 bp, Homo sapiens
  misc_feature 2: n = A,T,C or G
gntcgcgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgt

SEQ ID NO: 30799 - DNA, 359 bp, Homo sapiens
  misc_feature 30: n = A,T,C or G
atcatccgtgagagaccattaaatcgttanttaggaaattttttaaatgagtcaactgcttttatacattttgacccagaatttcaatttcagcttcatcaaaagaaggtgactgggaatgtttacaaagacttggccacaaggatattcatcacagtattgtttataatagcaaaagaaaaaatggaaagaacaaagggaatgagggagagagggaaaagaaaaacatctaaatggtaacaacctaaatgtctgacaataggtaatctgttagataagttatacttcacccctaaataattaaacaatgttgtagaagaataattactgatgtggggagtggggaatgttaataatat

SEQ ID NO: 30800 - DNA, 500 bp, Homo sapiens
  misc_feature 406, 436: n = A,T,C or G
ctaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagngaactcttttctcattctctttggttttgnggcactttcacaatgtagagggaaaaaccaaatgaccgcactgtgatgtgaatggcaccgaagt

SEQ ID NO: 30801 - DNA, 243 bp, Homo sapiens
tgggaggccgaggtgggcagatcacgaggtcaggagatcgagaccatcctggctaacacagtgaaaccccgtctctactaaaaaaatacaaaaaattagctgggcatggtggcgggtgcctgtagtcccagctacacaggaggctgaggctggagaatggcgtgaacccaggaggtggagcttgcagtgagccaagatcacgccactgcactccagcctgggcgacagagtgagactccgtct

SEQ ID NO: 30802 - DNA, 398 bp, Homo sapiens
  misc_feature 29, 31: n = A,T,C or G
caagcccaacacattttctggtgataccntngtaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcattgac

SEQ ID NO: 30803 - DNA, 490 bp, Homo sapiens
  misc_feature 7, 32, 33, 420: n = A,T,C or G
cagaacncacgatgttgtcaaggatggttttnngactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggngaatcggttgttctttcctcacatttggatgattgtcataagggttttagcatgttcctccttttcttca

SEQ ID NO: 30804 - DNA, 182 bp, Homo sapiens
  misc_feature 29: n = A,T,C or G
aatccacttctaaatgcagccgatttacnttaaacattccccttgcaacccctcctcccccacccacctcactctacctgaaaagatggctaattatgttagggccttgtgtattcatttatttgttgtcaaaacccggcggggtgttaagctctgaaatggggaaaaggctctgagggcga

SEQ ID NO: 30805 - DNA, 445 bp, Homo sapiens
ctccctcgctggagcggccagaaaaaggcgctggaaaaagtgaatttcgtaaccagaagccgaagccggagaaccaagatgaatcagaactccttacggttcctgatggttggaaggagccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagt

SEQ ID NO: 30806 - DNA, 220 bp, Homo sapiens
ctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtg

SEQ ID NO: 30807 - DNA, 125 bp, Homo sapiens
caaaatgtacaaacttagaagaaaattggaagatagaaacaagatagaaaatgaaaatattgtcaagagtttcagatagaaaatgaaaaacaagctaagacaagtattggagaagtatagaagat

SEQ ID NO: 30808 - DNA, 325 bp, Homo sapiens
  misc_feature 6, 7, 17: n = A,T,C or G
agaagnnaccttcgagnagaaaaaataagattacttaagcaggtgctgagagagaaagaagcagctcttgaagaaatgcgtaagaagatgcaccaaaaataaaatctcctgtaaggacttcagtgaaatagctgttttttaaaatatacttcagcattaataagttaattgtaggtgtgttctgaaagtgtctttgaatatgaagcttgttttttcatcagtcgattgtacaactttaaggaatacagaaaaggttgattcacatatgacttgtgaataatttacatggggtatctatacctttgtcttagatacctttttttgg

SEQ ID NO: 30809 - DNA, 359 bp, Homo sapiens
  misc_feature 8: n = A,T,C or G
aataccgnaagaatgttctatcagtaaaagtaaggttttaagtatgaatctccatttttgtggagtttttctaccctgtaaaaattaactttgtggttcccagtaattacagtaaggagtttttctatattttcacagttggatttatctaaggatatttctcagcatattaaggaatccttttctacatttgagcaaatactgaggttcatgttgtaccaaataataataaattgcttttgtgtttaatatgtaacacgtaagaacaattgaaattttcttctaagatttaatactagtcttttagtataaaggaatgtaactggagaaaaaaattaatgctacagccatttatcctg

SEQ ID NO: 30810 - DNA, 377 bp, Homo sapiens
  misc_feature 31: n = A,T,C or G
gaggccttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatg

SEQ ID NO: 30811 - DNA, 470 bp, Homo sapiens
  misc_feature 5, 6, 15, 29, 36: n = A,T,C or G
gaagnnctgaaaaanaaaacataggtctnttaaacnggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgaga

SEQ ID NO: 30812 - DNA, 331 bp, Homo sapiens
  misc_feature 20, 24, 46, 231, 311: n = A,T,C or G
tatggccgggaagaactacnaagnaatgataaagtatttattactntgggatagtaggggtattaaaggcataaaggtctgtttgaaataattttttttttcttctgagacagggtctcactctgctgctcagagcacaatggcacaatcacagctcactgcagcctcgacccccaagacttaggtgatcctcccacctcagcctcccgggtagctgagactacaggcatntaccaccacacccggataatttttttgtattttttgtaaagatgaggttttgccatgttgcccaggctggtttagattgngctttcttagtgcttttttc

SEQ ID NO: 30813 - DNA, 129 bp, Homo sapiens
agaagcagatctagtctatatgttaagacattcccttgctaattattttcttctctgttgttctatttttttggtccagtttgctgtttttaaagttttgagtcccagctggtcctgtacatttaactg

SEQ ID NO: 30814 - DNA, 318 bp, Homo sapiens
  misc_feature 30: n = A,T,C or G
ggaacatggcggtaggctgggaccataacncaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttg

SEQ ID NO: 30815 - DNA, 231 bp, Homo sapiens
  misc_feature 16, 21, 41: n = A,T,C or G
tacggccgggcaagcntaagnacgacgctctccctgcctgnccctgctatccggaaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttt

SEQ ID NO: 30816 - DNA, 229 bp, Homo sapiens
  misc_feature 6, 29, 30, 228: n = A,T,C or G
agaacngggagtgattacttctgtctganntatctgtggaagtcttcacaaaattcggaaggttttaaaagattttgatggtgggggaaggggggagggatattattaggagatatacctaatgttaaatgacgagttaatgggtgcagcacaccaacatggcacatgtatacatatgtaactaacccgcacattgtgcacatgtaccctaaaacttaaagtataatnt

SEQ ID NO: 30817 - DNA, 395 bp, Homo sapiens
  misc_feature 5, 6, 29: n = A,T,C or G
cattnntctccatacactctgggttctcncacctctgcaccttggctcaggttttcccctttagctagaatgccctttttccttggctttggctgtctcctaatggattactcgctgtacctacccttctaggctgagctcatagctagcatatgtaatctaacatttgaatcagttgagaaaactcttattttcctgctctatacacccagtatagttggtttgcaggtgtctgtggagtttgttttatacagtgcctgttgggctagagctgcattatagctagtgtctgtaagaccgttctagtttaagagcatgcagggtggcaacagtgagatgagactggctgtatcagtttatggctgttcagtttatggcaggtgacttaaactgag

SEQ ID NO: 30818 - DNA, 315 bp, Homo sapiens
  misc_feature 7, 31: n = A,T,C or G
ggaacangttaccctagggataacagcgcantcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttac

SEQ ID NO: 30819 - DNA, 486 bp, Homo sapiens
  misc_feature 5, 32: n = A,T,C or G
gaagncggcatctcaaatcggctgattctgtntctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggagaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccct

SEQ ID NO: 30820 - DNA, 289 bp, Homo sapiens
  misc_feature 15, 18, 34, 35, 37, 38, 42, 43, 45, 49, 50, 51, 52, 54, 60,74: n = A,T,C or G
aagagcacttttgtntgnggggcaaaataggggnnanntggnnangtcnnnncnataagntgaccgagcctggngatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacc

SEQ ID NO: 30821 - DNA, 416 bp, Homo sapiens
  misc_feature 6, 31: n = A,T,C or G
gaaatnttgttttaatatttgttgccagttntgttctttcttcacagccgctccaggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacga

SEQ ID NO: 30822 - DNA, 129 bp, Homo sapiens
  misc_feature 127, 128, 129: n = A,T,C or G
tcgatgaagaacgcagttagctgcgagaattaatgtgaattgcaggacacattgatcatcgacacttcgaacgcacttgcggccccgggttcctcccggggctacgcctgtctgagcgtcgcttgcnnn

SEQ ID NO: 30823 - DNA, 360 bp, Homo sapiens
  misc_feature 7, 32: n = A,T,C or G
gactgcnataggaatcatgtctggtcgcggtnaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagtacgccaagcgcaaaactgtcacagccatggatgtagtatatgccctgaaacgtcaggggcgcactctgtatggcttcggcggctgaatctaagaatacgccggtctcctgagaacttc

SEQ ID NO: 30824 - DNA, 139 bp, Homo sapiens
  misc_feature 31: n = A,T,C or G
gggcgcctgtaatcccagctactccagaggntgagataggagaatcacttgaacttgggaggcagagattgcagtgagctgagattgagccactgcactccagcctgggcaacaaagagtgaaactccatctccatcac

SEQ ID NO: 30825 - DNA, 330 bp, Homo sapiens
  misc_feature 8, 14, 21, 24, 25, 83, 154, 193, 261: n = A,T,C or G
gaaaaacntcgcangagacanagnnttataagcctttaacaattatggcttcagaagggagttgaagtcagtgaaggaaacanagaatgctgaaagaaataccagaacaggtggaaccaaattttaaaaacaaaagcatcgtatttggagtcanaacacctggctatttttatactttagctctgtcaacttnggcaagttagaaagtctttctagggcctccatctccttatctgagaaatggggaccaataaagcttgntttcgtttactttttaaatctcccaagctttttgtgcatgtgtgacaataaaatggattattatatgca

SEQ ID NO: 30826 - DNA, 310 bp, Homo sapiens
  misc_feature 6: n = A,T,C or G
gacacncttttatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctgga

SEQ ID NO: 30827 - DNA, 327 bp, Homo sapiens
  misc_feature 22, 158, 189, 239: n = A,T,C or G
ctaaagctgggagactgaaaanatgcagaccgccggggcattattcatttctccagctctgccttcctacagcaacttcccactccaggtggccaggacgggagttccagaccagtgttgtctcccgggacattgacacagcagccaagtttattggngctggggcagccacagttggtgtggctggtncaggggctggcattggaaccgtgtttggcagcttgatcattggctatgcnaggaacccgtctctcaagcagcagctcttctcctatgccattcttggctttgccctgtctgaggccatggggctttttctgtttgatg

SEQ ID NO: 30828 - DNA, 357 bp, Homo sapiens
  misc_feature 31: n = A,T,C or G
caaagccagattacaatttggttgctggcantcattctgggtttcttgattttagtactccaaagaatatggtggtctcatggagtagctgaccactaaggaggggaggattaaaagggaatcacttatcagtttttagcataggatgcattaagaaatatcaacggataactgacatcgttttgttaagaagttaactgtatcatagctcactactgccagagcggcaatggatgtacaacgaaagagatgaaaaatacaaaagttattaagccacctgattaaaagaaaaccaatatttaaaggcatttaatagatatcaagtataactttgaggagaagaatcaatctgtatta

SEQ ID NO: 30829 - DNA, 290 bp, Homo sapiens
  misc_feature 17, 42: n = A,T,C or G
tatggccgggcaagccnatgagcatcaattacccctgtcacnttgttggataatttggagtattttagctattagcaagctattagcataacagacattaaaatgattaaaatatcagtgattactttaatccctagggctataaaatgattcttttacaaaatgcataatattaaaaaaacatttaatttgttttagaggatcggcttttgtttccaaagattcttttagcacctactgaaaaatatgacatagtgtaggctgcagtaactgttcttggatggttttcg

SEQ ID NO: 30830 - DNA, 479 bp, Homo sapiens
  misc_feature 14, 23, 152, 467: n = A,T,C or G
ctcaccccaaatgncaccaaggnggctgagggccacaaagctagtttctgtctcgaagacactgagtgtcaggaggatgtctccaagcggtatgagtgtgccaactttggagagcaaggcatcactgtgggttgctgggatctctaccggcntgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaagtgccactgccctctgcaaaccaccactggcccctaatggcaggggtctgaggctgccattacctcangagcttaccaag

SEQ ID NO: 30831 - DNA, 481 bp, Homo sapiens
  misc_feature 5: n = A,T,C or G
ggggnctccgggatggtctctagccctattgatgatgaacactggccttctggaggggaaatggcagtctgggctggcgtggtaggaagggctttggtgttcatggaatgggcctgctgctctcagaccttcaaaggatggaaccaacgaaggaccaaatgagaaagcagatgctgtgccttgcagagggccatgaatgtcagttattatttttctccttatacaattattttgtggttattattacaatgtacatggctgttgcatagaagacatgactggtggaggctgaggaaagccatgacattctacaattgccatcaggctaaggccccgtgagcatttctctcccttgtaatattaaccctgtatttctgggatcacatcacggaatattctttgcctttccactttccaggaaatctctcggactgggctaccctccttgtgtgtgatgaaagatgagctatatttcagaaca

SEQ ID NO: 30832 - DNA, 131 bp, Homo sapiens
  misc_feature 55: n = A,T,C or G
atatcaataatatttacatccaatacactgaatcttcctttagaggtaagacttncatatctatactgtaaatatttggtttatttggcactactgaagttttgtttttcacaaagctcttattatgaagc

SEQ ID NO: 30833 - DNA, 144 bp, Homo sapiens
gtgtgagctactgtgcctggcataggttgtttttaatacagaaaaatattttaaaaaccagaagcagcccataatcctagtagccttgataactcttatttaacatttaaatttaaaatgaaataatatctttgcatctttaag

SEQ ID NO: 30834 - DNA, 487 bp, Homo sapiens
  misc_feature 6, 29, 31, 439, 442, 452: n = A,T,C or G
aaggcnatgagtagtaaatgtattaaaantnctatatcacagaggtgaaattaagagttcttggcatattggcagaacaagatacaggaagaaactgagaaatctggtacatttttgccagacttttgctgttttgatgccgtgcacacagtaggcatttagtaaagatctttgaatgaactgaatatattcttttggtgaactggcaaagcagtgatcccccaacgtagtgtgtttgcatgttgatttatttatttaataaatatttgctgtgtacttactagatgtcaggccctgctgtgatggtatgtgcattctagtgggataaaactgtcaaaaaatacattttaaaaaccaggtaatggtaagtgctatgcagaaagttgaaataggataaagtatttgataatacttcactgggtggctacatttttgttgntgntttgttttgnttttgagacgcagtcttactctgtagcccaagctg

SEQ ID NO: 30835 - DNA, 373 bp, Homo sapiens
actcactgccttgagcctgcctcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaatac

SEQ ID NO: 30836 - DNA, 418 bp, Homo sapiens
  misc_feature 28, 29: n = A,T,C or G
attcctttactggatcttcacagttggnntttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcacctcgtgtgcaacagacaagtgactgtatctgtgtagactatttgcttatttaataaagacgatttgtcaagttatttc

SEQ ID NO: 30837 - DNA, 377 bp, Homo sapiens
  misc_feature 5, 6, 32: n = A,T,C or G
gggannaagatgcacccaccagtgtaaagttngaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacag

SEQ ID NO: 30838 - DNA, 472 bp, Homo sapiens
  misc_feature 10, 30: n = A,T,C or G
tatgacaatnattacattataaaaggaatntctaatgcagaaacaaagatgcaactttcaaaattcttattattcctatttgtatatacacgagagaacccaaccagtgcctgtgtttggggggaaaagtcaacagtgtagttctaaaccttatcccaaacagaaaatgtggttaatgatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatgggatttactataataatccaagtatga

SEQ ID NO: 30839 - DNA, 500 bp, Homo sapiens
  misc_feature 9, 10, 34, 55, 349: n = A,T,C or G
gaccctcgnnttttacggccgggcaccgccaggnggcctgactggcattgtattngcaaactcatcactagacatcgtactacacgacacgtactacgttgtagcccacttccactatgtcctatcaataggagctgtatttgccatcataggaggcttcatttcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacatcacatgaaacatcctatcatctgnaggctcattcatttctctaacagcagtaatattaataattttcatgatttggagaagccttcgcttcgaagcgaaaagtcctaatagtagaagaaccctccataaacctggagtgactatatggatgccccccaccctaccacacattcga

SEQ ID NO: 30840 - DNA, 432 bp, Homo sapiens
  misc_feature 5, 33: n = A,T,C or G
agtancacttcacttacaaaaaaaaacaggttntgggcagcatttggcctgtgagccataatttgcctacttctgttctacatgaatgtgataaaaggtagcctatgagagatccaaagggtaaggaccagcgtttctctaagggggttctgtggaatactaatacgagagtcctgggagccacccaactcttaggggactagaattcttgggggtagggagtatggggctacaaatcctttagttttagttatggttttgttgtttgttttgtttttaacagataagtcttacaaactaaaatttgaggatcactagctaagattgtcaatgatatttagcaacaaatattgcccccctgccattcataccagagtcactacagtgaacaagataaatagaaattcttgtcttcatagaacttagtctact

SEQ ID NO: 30841 - DNA, 445 bp, Homo sapiens
  misc_feature 29, 32: n = A,T,C or G
ggaacctggctaactgcaagctgaagacnttncacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcaccctccctggcctggtctgctgatggccagactctgtttgctggctacacggacaacctggtgcgagtgtggcaggtgaccattggcacacgctagaagtttatggcagagcttt

SEQ ID NO: 30842 - DNA, 367 bp, Homo sapiens
  misc_feature 31: n = A,T,C or G
atttccttgattataactataatgataatgnattagtttatataaacctatgtttagacaagttcaagacaagcgtgtctttctataaaaagtattgaaagtgaaggaaatgagatcatgtttcaatttattaaagcagggaagagcgttctgtggttagttcgtgtctaggatttgagtgccttactgaatgtatttaccagcaaacatgtagcaatctgttctctcattgtgattgtggaagaagctcatgtaaaatgatagtcattaatgaggaagtatggcgtggtacttattctgtaagttcagagtatgctgagtgttaatagattgtcatattgcctgaaaataaattcatgatgacctg

SEQ ID NO: 30843 - DNA, 490 bp, Homo sapiens
  misc_feature 5, 30, 32, 392, 456: n = A,T,C or G
gaggncaagtgtcggcgccgccactgtccntncacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggngagaagttaaatggcacagatcctgaagatgtcatcagaaacgcctttgcttgctttgatgaanaagcaacaggcaccattcaggaagattacctaag

SEQ ID NO: 30844 - DNA, 378 bp, Homo sapiens
  misc_feature 181: n = A,T,C or G
attaggatagattaatgtcatctctgtgtcccaagagtcacaacatattgataaaacggtgatcaggatgccgttataaaacgacatcctgtgtaagtcagtgtggctactcacagaagatccccaacatggattggtgagtccacttggaaaaaggaaaacagtgtactttgtggctggnggttctgtagtcaaaggcatagtttcctggacaaacatgaagcctaaactgtattcacaaggaaaaatggcaaaagagaaagcccagatttaaaaggtagaagggaattgattgacacaagagaaggatattcaagtgcaagtagaatgaaagaaacttcgctgagttgagatcaatgaatttcaaagaaggttaga

SEQ ID NO: 30845 - DNA, 469 bp, Homo sapiens
  misc_feature 7, 58: n = A,T,C or G
aaacacnccatattcaggacttgaactcagttttggaccaagtggacctaatagacanctacagaactctccaccccaaatcaacagaatatacattcttctcagcaccacatcgcacttgttctaaaattgaccacataattggaagtaaaacactcctcagcaaatgtaaaagaatggaaatcataaacagtctctcagaccacagtgcaatcaaattagaactcaggattaggaaactcactcaaaactgcacaatgacatggaaactgaacaacttgctcctgaatgactactgggtaaataacgaaattaaggcacaatgacatggaaacggaacaacctgctcctgaatgactaccagggagatgaagaagcaaatcttggtctgcccatcagtccattcatggatcgttcttctcctcaactagcaaaactccaagaatcttttatcacccacatagtgggt

SEQ ID NO: 30846 - DNA, 400 bp, Homo sapiens
  misc_feature 398: n = A,T,C or G
atgaatacataaatatagagaatactgagataaatagaacgtggattatttggagttcatcctcctgagctaatgatgggcatttctggaagtgctgggttgcaaataagcccagaccagagaggattgtgtttaaaggcccagaatctcaactgataatcctcagaagctcagatttacttttttcattccaagtaaattaaactggagtggtaagaaaaagaaaaatggttatgaccatcaaccccagaaacagggaccacatttaattgaatttataatgtccctaacatctctgctgtgtttgaaaggttaaaaatttcctagagaaaacagcttttgctactacttgccaaagtactcataaaatggactgattgctaagaacagaaaacaanct

SEQ ID NO: 30847 - DNA, 484 bp, Homo sapiens
  misc_feature 5: n = A,T,C or G
gggancggaaatggctgccgaaaacaagcttttaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctc

SEQ ID NO: 30848 - DNA, 112 bp, Homo sapiens
  misc_feature 7, 31, 32: n = A,T,C or G
atagtcnatgcttttttttccgtttttgttnnttttggatgctggtgctaaacctccaagtgtcatgatttaaaaaaaaaaaaatttatgtccttcttatttatttctagga

SEQ ID NO: 30849 - DNA, 465 bp, Homo sapiens
  misc_feature 179: n = A,T,C or G
gaatgtctagataagactaccatcccgtggtcaatcactggaatcactgaagtatttcaactgagtgaaggaagtgccactcagcttcagtctgggtggcagagtcctttcaaatgtggcttcagcaccgactttctgtgcattactcatgctgtgaagtaggtgatttaagccactgnctttctaaattaaaggcacaaaaaggcagacatgtaattcttttaattacacattcatatttctcctacattcctctgagtcgttcatgtctgcctcctgcctcatcagcctacaagcagaaaacaagcaacagggaatgtggaagatctgtaaagggatgaaaaacccaactcactcgtttgtactgtggcttttctcaaagaaaaataaaagcaccgtgtctggaaacagacaatgggagatctgacttctaccgatcgtagggaatagtgaagtatttcaaga

SEQ ID NO: 30850 - DNA, 261 bp, Homo sapiens
  misc_feature 33: n = A,T,C or G
atatactgtatatataaaaatcttgagatggtngaaacatgtatgaatgtactaagtagtattccactgtactcattcataaggtaggttttcttacaaaactcacaccaggtacttaaagatgtgctctgcttttttccaactacggagtgtcactgctttctagctcagtccctgcagactcttctcaactctttccctataggaaacttactccgcgtcctgcccccacctcctaaataaataaaggaatcggcgaac

SEQ ID NO: 30851 - DNA, 426 bp, Homo sapiens
gagtaccctgggattacaggcatgtgccaccttgcctaatttttgtatttttagtagagactgggtttcaacatgttggccaggctgctgttgaactcctggtctcaggtgatccgcctgcctcagcctcccagagtgccgggattacaggtgtgggccacctcgcctggcccatacaattttttaaagggcattgagatcctaaaattgaaattgtagatagatatagctgtgggataaagaacttctgctgaatgatgatttgcaaaagtatgtcttcagtatagtactgagtactaattttatggggcaaataactctgtatttaatcttatgaccttgtataaaatcttgccctaaactaaattcaaatgtatagtcatttatacttaattacaaaatttggtgctatgttaatatttacca

SEQ ID NO: 30852 - DNA, 180 bp, Homo sapiens
  misc_feature 24, 176, 179: n = A,T,C or G
tgctgatgaatttgaagacatggnggctgaaaagcggctcatcccagatggctgtggggtcaagtacatccccagtcgtggccctctggacaagtggcgggccctgcactcatgagggcttccaatgtgttgcccccctcttaatactcaccaataaattctacttcctgtccaanaana

SEQ ID NO: 30853 - DNA, 104 bp, Homo sapiens
  misc_feature 104: n = A,T,C or G
agttttaagttattagtttttaaaatcagtactttttaatggaaacaacttgaccaaaaatttgtcacagaattttgagacccattaaaaaagttaaatgagcn

SEQ ID NO: 30854 - DNA, 384 bp, Homo sapiens
  misc_feature 27, 157, 238: n = A,T,C or G
ctaaagctgggagactgaaacaatgcngaccgccggggcattattcatttctccagctctgccttcctacagcaacttcccactccaggtggccagacgggagttccagaccagtgttgtctcccgggacattgacacagcagccaagtttattggngctggggcagccacagttggtgtggctggttcaggggctggcattggaaccgtgtttggcagcttgatcattggctatgcnaggaacccgtctctcaagcagcagctcttctcctatgccattcttggctttgccctgtctgaggccatggggctttttctgtttgatgggcgccttcctcatcctcttcgccatgtgaggctccatggggggtcaccggcctgttg

SEQ ID NO: 30855 - DNA, 143 bp, Homo sapiens
  misc_feature 22: n = A,T,C or G
ccactgtccacatgctgttctntcctcgcatctcctgttcctgcttccctttggcttgctcacctctggctcctcatggccccagtgaagtatcgtggcttcctctccactgcagactggcagatttcttcactcacactccc

SEQ ID NO: 30856 - DNA, 496 bp, Homo sapiens
  misc_feature 3, 5: n = A,T,C or G
agnanacaaggcagacaaaggttcatttgtaaagaagctccttccagcacctcctctcttctccttttgcccaaactcacccagtgagtgtgagcatttaagaagcgtcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccaca

SEQ ID NO: 30857 - DNA, 144 bp, Homo sapiens
  misc_feature 16, 22: n = A,T,C or G
ctaaagctgggagacngaaacnatgcagaccgccggggcattattcatttctccagctctgccttcctacagcaacttcccactccaggtggccaggacgggagttccagaccagtgttgtctcccgggacattgacacagcag

SEQ ID NO: 30858 - DNA, 144 bp, Homo sapiens
  misc_feature 144: n = A,T,C or G
aagtaacatgaaaacattctcctccgcataagcctgcgtcagattaaaacactgaactgacaattaacagcccaatatctacaatcaaccaacaagtcattattaccctcactgtcaacccaacacaggcatgctcataaggtn

SEQ ID NO: 30859 - DNA, 471 bp, Homo sapiens
  misc_feature 30, 32: n = A,T,C or G
agcagcctccctataagcttctgtttgggntnccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttg

SEQ ID NO: 30860 - DNA, 427 bp, Homo sapiens
  misc_feature 26: n = A,T,C or G
ctctttgaaagatagagattaatacnactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggaga

SEQ ID NO: 30861 - DNA, 183 bp, Homo sapiens
  misc_feature 5, 31: n = A,T,C or G
attgncatgacaaattttcatcttactgctnatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcc

SEQ ID NO: 30862 - DNA, 377 bp, Homo sapiens
  misc_feature 143: n = A,T,C or G
gtgctgcgcactaaagcagatactccagtaagtggcctggcttactcaggctgagaggttaagtaggccacaacgagaaagtaggaaataagacattagctttgaacacaaaactttaaaggaactctagggtcaggtgggcnatctaaacatctgacattattttgaattatatcaatattacaaaaggaatatagatagcatgatggtttctgttttaaataaacttctttcacactatggaataaaatatcgtctatgggtagattaaaatgaaacccctttgggatttggttaaatctttgatatttactttatcatgtgttctttctgattttgaaaactgtctgcaataggtggagcttctttgaattaga

SEQ ID NO: 30863 - DNA, 158 bp, Homo sapiens
cttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccc

SEQ ID NO: 30864 - DNA, 387 bp, Homo sapiens
  misc_feature 23: n = A,T,C or G
atttttaaaagtcaaaaattaanacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtaaac

SEQ ID NO: 30865 - DNA, 191 bp, Homo sapiens
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatg

SEQ ID NO: 30866 - DNA, 146 bp, Homo sapiens
  misc_feature 16: n = A,T,C or G
ctaaagctgggagacngaaacaatgcagaccgccggggcattattcatttctccagctctgccttcctacagcaacttcccactccaggtggccaggacgggagttccagaccagtgttgtctcccgggacattgacacagcagcc

SEQ ID NO: 30867 - DNA, 257 bp, Homo sapiens
  misc_feature 14, 257: n = A,T,C or G
atctacagtacagnaagatatttccgacagaccatattcacgtaagttttattacactatattcttacaacttatttttttaatttaaaatatggaatgcctaacgaatgtgcgtgtcatccttgcgcaggggccatgctaattaccgtatcattccaattttagtatatgtgctgctgaagggagcgtttttctattttattattgttgatcttttactatgtctaatttataaattaaactttcatgtgtatacn

SEQ ID NO: 30868 - DNA, 434 bp, Homo sapiens
  misc_feature 21, 32, 35: n = A,T,C or G
gaaagcacagagagaagaatnaaatagacacnttnaaaatgataaaggggatgtcaccaccgatcccacagaaatacaaactaccatcagagaatactataaacacctctatgcaaacaaactagaaaatctagaagaaatggataaattcctggacacaaacaccctcccaaggagagattcaaccaggaagaagttgaatctctgaatggaacaataacaggctctggaattgaggcaataagtaatggcctaccaaccaaaagaagtccaggaccagggggattcatagccgaattctaccagaggtacaaggaggagctggtaccattccttctgaaactattccaatcaatagaaaaagagggaatcctccctaactcattttatgaggccagcatcatcctgataccaaagcctggcagagacacagc

SEQ ID NO: 30869 - DNA, 270 bp, Homo sapiens
  misc_feature 9, 14, 30, 80, 85, 133, 134, 150: n = A,T,C or G
accctgcancttgngagtaaggataatctngtaggggcaacctctactcaggatgaatcatcgcaaaatcattgaatcangcttnagtgcagtgatatcacgcatgaatttctgctcgattagcttacgttgnnagggatagaggccaancaaggctgttatcggtacgaggaatggatgttcgatttctgtagaatacgcctgagagacggcgaatactctcacgagaggcagcaggctctgtaaattacccaattacaacaagtagag

SEQ ID NO: 30870 - DNA, 367 bp, Homo sapiens
  misc_feature 11, 35, 37, 38, 43, 56, 67, 71, 75: n = A,T,C or G
atagcaaaagngggtaaaacccctgagtttgcganannagtantcttgtaggggcnaactctacttnagangaantcctcgcaaaatccttgaatcaccgcttcagtgcagtgatatcaccgccatgaaatttctgctcgattagcttacgttgtttggatagaggccaaacaaggctgttatcggtacgaggaatggatgttcgatttcgtagaatacgcctgagagacggcgaatactctcacgagaggcagcaggcgcgtaaattacccaattacaacaagtagaggtagcgaaggaaaatatgaggggtggcaaggttttgcctgttacattctcaaatggaagcaaattagatatgtcattg

SEQ ID NO: 30871 - DNA, 458 bp, Homo sapiens
ggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 30872 - DNA, 130 bp, Homo sapiens
atctctagagaggacatccctgctgggctgctgtgcagagtataagattttggacttgttcatgtcccctctctccctataaatgatgtatttgtgacaccctatcttgtcaataaacagcattctgatt

SEQ ID NO: 30873 - DNA, 134 bp, Homo sapiens
gggaagatttataggtagaggcgacaaacctaccgagcctggtgatagctggttgtccaagatagaatcttagttcaactttaaatttgcccacagaaccctctaaatccccttgtaaatttaactgttagtcc

SEQ ID NO: 30874 - DNA, 197 bp, Homo sapiens
  misc_feature 197: n = A,T,C or G
ggagggcggtggtctgttacagggtgtgcaggggcagagaaggaagggaccaggggactgggccagtatgtggaggatggggcctgcgtgttcaaagccaaggcccgccccttccttgtgctcaaatggccaaagctgttcacgtctgtgctcaaccatctgcttcaaattgaagtaaaagccccaaaatgtcaatn

SEQ ID NO: 30875 - DNA, 306 bp, Homo sapiens
cgcttctgactgttaaacaccgatgacgcatgcacctgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctg

SEQ ID NO: 30876 - DNA, 252 bp, Homo sapiens
tgcaggggactcacgcctgtaatcctagcactttgcaggccgaggcgggcggatcacttgagaccaggagttcaagatgagcctggccaatatggggagaccccatctctaccaaaaatacaaaaaaattagccaggtatggtggcacgtgcctgtaatccaggctgaggcaggagaatcacttgaacctgagaggtggaggttgccacactaccacactccagcctgggcaacagagtgagagtccgtctt

SEQ ID NO: 30877 - DNA, 248 bp, Homo sapiens
gggtgggaacatgtaacttgtagactggagaagataggcatttgagtggctgagagggcttttgggtgggagtgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagctc

SEQ ID NO: 30878 - DNA, 115 bp, Homo sapiens
gggtgttccgaataatatcctggaagttatcaggacacctattttaaatataggcctgaattttgtaaagtaatatttaaggtggtccgtgataattaaataaaatgcttaattc

SEQ ID NO: 30879 - DNA, 202 bp, Homo sapiens
  misc_feature 6, 16, 28, 43, 47, 67, 74, 75: n = A,T,C or G
tctttngcccgggaanctggtgtgagtnaaatgcccccctgantganctgcccccagccccaggccnagaagannctcccttcaggtgcccgggcgcaggaacctgtgtgtgtccctacacaatggtgctattctgtgtcaaacacctctgtattttttaaaacatcaattgatattaaaaatgaaaagattattggaaagt

SEQ ID NO: 30880 - DNA, 472 bp, Homo sapiens
ggaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtgggaagtcaccattacaga

SEQ ID NO: 30881 - DNA, 343 bp, Homo sapiens
  misc_feature 15: n = A,T,C or G
agcaaatatttattnagtacccgaagtgctagaaactatatgagggtagtaaataaaatagaatattcctgtcctactatggagggggaatggagagggagtggaggaatagatgataaacaaacaaacaaacaagcaaactagttcattgtacataaagaagttatttttttctgacagtaactaacaaaggtctgggcaagaatcagagggtgaccattttaagaggtggtgtttctgttgagactcaaatgataagaaggatccagtgatgcagaaatccagggcaaggaataggatgtttgaagcctccatagaagaaaagcattttatagtagatcag

SEQ ID NO: 30882 - DNA, 473 bp, Homo sapiens
ggaaaaagctgaaagctttctagaaaggtaaaggagtttcatcagagtaacggtaatacaatgtgagattcagaatgttcttcctggtttagtaatttcaccttcacaagaaggggctacatcaaggcttccccagggtagctttgcagctacagtcagattgtgcagattcactgagacaaaggcctagggagagaggagaaagcacttccttggcggctgtgttgggccagctttactagaagtggagtctgacacacttttgtgcaatgatttattgaggataagctctcatgagaaggaagtaagagaagcaggaagaggcatggaaggagttaagcgaacttgtatttcaagagaggtctaacctcagcttgatctcactggaagctctggagaatgtgaattgcaccatagttacccaccaagagccaagagaattggactgttaaacttcaacattaatttgtcat

SEQ ID NO: 30883 - DNA, 215 bp, Homo sapiens
gagcctgaatctcagcctgctgctgatgatggagaagccagcacttcactgagtacttccttggtgccccgtcaccacccaacacctcctcacaaggcttgcagaagagcctgctgagactcagagagtctgtatcctgccccaggtcgcagctgtgtggcatcctgatctctgtgtattttaaccaagatcttgatgttccctttttgtaatgg

SEQ ID NO: 30884 - DNA, 472 bp, Homo sapiens
  misc_feature 27: n = A,T,C or G
gataccaaagtgcgaaaagttactttnatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacac

SEQ ID NO: 30885 - DNA, 466 bp, Homo sapiens
  misc_feature 11: n = A,T,C or G
gcaacaaaatngcagagttgatgcagctagcctgaaggactgaataatttggctaagttgggattgagtttcaacagcatctctgctgttgacaatggctctctggccaacatgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctag

SEQ ID NO: 30886 - DNA, 466 bp, Homo sapiens
  misc_feature 1, 10, 30, 31, 34, 42: n = A,T,C or G
naattcggcnttatggccggaggaaaagannatnttgggtantgcattcttataatctggttttgtctagaaaaactcattcaaggtaaccttaattttaagatttatcattaaaatcatgtgtaactttacagattatttaaagtagatgaaaacaaaatagttcagctttagcaaataatatagtattatttaactctgattaaatttgaggaagttgcattttgccatttattttgtattgaaagtcactttggagatcacacattgaaccctatttatgagattgagaaaattgtctgtggtaggctcccacctgcagctgtggatggcctcgtatgtgtgagaaagacatcttgaaagttagagacaatggccattatcatcagttcttgaaataatattactctggttttaaagggttaatggatctggctgggggtaataaaggcaattccttttttat

SEQ ID NO: 30887 - DNA, 308 bp, Homo sapiens
ggggaatggattgagttgggccgaagtggaagaagggaaaccagttgggagacctctgttgtagcataggagaggagtggtggtcttgtgtaaggatcgtggcagtggagtcagagagaaacgagtggatttgagatgtgttcttcagcttatgtgacttccagggagcattgttagatacaggcttgaagatggaaaaggaggtctgggctagaaatagaaacttaagagttgttgtcttagaagatgatatttgaaaccataggagccaattagatccaaaggaaatagaatgtagtaaagtgtag

SEQ ID NO: 30888 - DNA, 472 bp, Homo sapiens
  misc_feature 25, 52, 110, 160, 168, 241, 351, 417: n = A,T,C or G
ggagcaacatataggcaacattttntgtttagtaaagtggccaacacaattnttttcttccgcttggatattcgcatgggcctactttacatcacactctgcatagtgtncctgatgacgtgcaaaccccccctatatatgggccctgagtatatcaagnacttcaangataaaaccattgatgaggaactagaacgggacaagagggtcacttggattgtggagttctttgccaattggnctaatgactgccaatcatttgcccctatctatgctgacctctcccttaaatacaactgtacagggctaaattttgggaaggtggatgttggacgctatactgatgttagnacgcgggacaaagtgagcacatcacccctcaccaagcaactccctaccctgatcctgttccaaggnggcaaggaggcaatgcggcggccacagattgacaagaaaggacgggctgtctcat

SEQ ID NO: 30889 - DNA, 179 bp, Homo sapiens
  misc_feature 85, 113: n = A,T,C or G
gtgtcccgggcgctgaggggaaaggaagcgggcatgattgtagacaatgagggggttctcttgatgtaatgaaatgcaattttantggtttggtgcaaaaactcctattttcnagtaaattaactttatttctaaagcatattttgatttgccatcaagagcaataaagcattaaatcc

SEQ ID NO: 30890 - DNA, 473 bp, Homo sapiens
aggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaaccttcttcccacaac

SEQ ID NO: 30891 - DNA, 469 bp, Homo sapiens
cacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaacctacaacag

SEQ ID NO: 30892 - DNA, 473 bp, Homo sapiens
  misc_feature 2, 14, 28, 341, 359, 413, 452, 465: n = A,T,C or G
cnctcaactctacncaatttactaagtnaggaactaattatatggattcatttttgtcaccaattatgtatgtgcaaaaaaaacgaaaaaacccctttgatatttatcgaggttatttgtgattgtaaagggcccaatattaaatgaactggttttgaaactataaatttgttccaaaatagtgttagtaagttcctcaccataaaataagcatgaattgagaggtacaatctctgaaaacattatcacaaagaatttttttgatctcctaaaaattattagtactgtaagaataaagtcaatgattattccataccacataatagggtattctaaaaatngggcaaaaactttactgnacttctttctatgtttcaggtaaatacaatattgccatctcggttttttttttnttgaaactacacaagaaaatagcaggcatctcttattgngttcaatggaggnattaactt

SEQ ID NO: 30893 - DNA, 175 bp, Homo sapiens
  misc_feature 4, 8, 16: n = A,T,C or G
aacnaacnaaccaacnaacaaacaaacagttagctggcatagtggaggtcctgttgtcctggctacttaggaggctgaggtgggggagtcccttgagcccaggagtttgaagttgcagtgagctatgattgtaccactgcacttcagcctgggccgcagagtgaaactctatccc

SEQ ID NO: 30894 - DNA, 178 bp, Homo sapiens
  misc_feature 1, 12, 26, 30, 40, 45, 53, 78, 86, 88, 93, 96, 109, 143, 166: n = A,T,C or G
ntggcccggganagtgccaccttttntgangttctgaaanttcantggttccncttgacctttttgcgtcaccttaantcccaaantnaaccnaanttcagggttgaantcttgaaattggctttctcaggcctcaaggtaancagtgttctttgtggtttgaccnaattgtttttct

SEQ ID NO: 30895 - DNA, 472 bp, Homo sapiens
  misc_feature 364, 447, 455: n = A,T,C or G
ggtgggtgggggaagctgagggctgagaccaagggctaaagctgggagactgaaaaaatgcagaccgccggggcattattcatttctccagctctgccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgcccctgtctgaggccatggggcttttctgtttgatgggncgccttcctcatcctcttcgccatgtgaggctccatggggggtcaccggcctgttgctactgcaactccacaccattcttggngctggggngtgttaagctttaccat

SEQ ID NO: 30896 - DNA, 226 bp, Homo sapiens
  misc_feature 5, 29: n = A,T,C or G
ggatnacttgaggttaggagttcgagacnatcctggccaatatggcaaaaccctgtctctactaaaaatacaaaaattagcgaggtgtggtggcaggtgcctgtagtcttcagttacttgggaagctgaggcaggagaatcgcttgaacccaggaggcagaggttgcagtgagctgagatcgcgccactgctctccagcctgggcgacagagtgagactttatccc

SEQ ID NO: 30897 - DNA, 382 bp, Homo sapiens
  misc_feature 20, 379: n = A,T,C or G
aggggcgtgaggtcccaggnaagtggccaaaaactagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtanttt

SEQ ID NO: 30898 - DNA, 179 bp, Homo sapiens
cagagaactctctggaaccttaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 30899 - DNA, 357 bp, Homo sapiens
  misc_feature 21, 356: n = A,T,C or G
agggaaataaatgaagtattnaaataaacctgcatatgtctagttaaagtgtgctaggcagaggaggagtcagtgcagagctctgggacagaagctttatttacttatttgaagaacgtactcagatagacgttttaataaaaatgctgtggatactatatggagaacaggctgtggggagacaagagcagtagcagaaatactggctgggaggttactgtgggactccaggaaagaggttatgaaatcttgacctagaatggtagcaaggaagtaggcagtgattggatttgcaatctgctttaaagacagaagtgacacacttttgattacaaactagatataaggtgtgaggnc

SEQ ID NO: 30900 - DNA, 429 bp, Homo sapiens
  misc_feature 404: n = A,T,C or G
gggagtggccaacatggcggaacgcaggagacacaagaagcggatccaggaagttggtgaaccatctaaaggagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatggataaagacataaagaaaggaaaaagataaaggaaaagctgaaggtggaaaaggaagaagataaaaagagcaagaaagaaaatntaaaggatggagaagacaaaaaaag

SEQ ID NO: 30901 - DNA, 500 bp, Homo sapiens
  misc_feature 6, 9: n = A,T,C or G
agtaanagngtgatccctgaattcagacgccagaacacctctcctatctagagaagatgggagctaaagatcatggagcgtggggctgagaagtagcttccattgaaactgaatgaaaatctattagtgtcctgaaaaccaagtgaagcctgcatttttaagagaagaaagtgatcagtgttgtcaatattgatgactgagggagtcctcagatggcactgccaaacttccaggttggggtgcttcctgtcctaataagaatgggaacaaatatttcatccttacacattgtgatgttcagacctcatggtttgtagccacttgatgtagtacttgtctacttttgaccctactagatgagttttcttaggtcatctacctcagtattacctgtgtgtttcatatgaaatattcctggatcccacctgcactcagggaatcagcatatctcagtataaggtggttggacattccagagattcctgttattggaataaaac

SEQ ID NO: 30902 - DNA, 261 bp, Homo sapiens
  misc_feature 3: n = A,T,C or G
atnagctgggaagctggcgtgggcaggccagctgtacctggcctggagctccagaagaggagccatgtcagaagaaacagtaagtgaatcacagttttccttgaagacagcagcgctaagagtgtttgatcttcctctgacttggtactattctctctcccagatcaaattttctccggtggctaaaaagttgtttgtggtaactgcagtgagtgctatatctgtaatttttctggctcatcactttaaaagaaaacgtga

SEQ ID NO: 30903 - DNA, 357 bp, Homo sapiens
  misc_feature 41, 356: n = A,T,C or G
gggattgggcctggtggtcttcttcttcgttttctactttnatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattnc

SEQ ID NO: 30904 - DNA, 351 bp, Homo sapiens
  misc_feature 21, 179, 191, 263, 287: n = A,T,C or G
ggtaactgtttcttttgtgcnttttggggtggagaaggtggatgtgatgaagccaataattcaggacttattccttcttgtgttgtgttttttttttgcccttgcaccagagtatgaaatagcttccaggagctccagctataagcttggaagtgtctgtgtgattgtaatcacatggngacaacactcanaatctaaattggacttctgttgtattctcaccactcaatttgttttttagcagtttaatgggtacattttanagtcttccattttgttggaattanatcctccccttcaaatgctgtaattaacaacacttaaaaaacttgaataaaatattgaaacccc

SEQ ID NO: 30905 - DNA, 219 bp, Homo sapiens
  misc_feature 1, 5, 6, 9, 24, 37, 40, 65, 120: n = A,T,C or G
naaannacnaaagcataatatttnacccactaagccnatnactttattgactcctagccgcagancctcctcattctaaccctgaatcggaggacaacccagtaagctacccttttaccnttcattggacaagtagcatccgtactatacttcacaacaatcctaatcctaatacccaactatctccctaattgaaaccaaaatactcaaatgggcccg

SEQ ID NO: 30906 - DNA, 277 bp, Homo sapiens
  misc_feature 16, 17, 20, 21, 25, 26, 38, 50, 52, 56, 59, 60, 61, 63, 67,70, 78, 82, 83, 98, 133, 134, 167, 172: n = A,T,C or G
tatggccggggaggtnnccnnaggnntatcactgcccnacatcaggaaancntggnggnnntnattnctnttgcctgntgcnnaaggtcaatactatnacattgatgtgccctaggagaacagcaagagcaannacctactcgttctgggcagaccttatccaaagnctggnacaactgtccttagactgatgagcaaaggaggagtcaactaatgaagaaatgaataataaattttgacactgaaaaacattttattaataaagaatattgacatc

SEQ ID NO: 30907 - DNA, 472 bp, Homo sapiens
  misc_feature 452, 456: n = A,T,C or G
tatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaataatgttgtcttttgtttaagcatttattttcaaacactaaggagctttttgacatctgttaaacgtctttttgttttttttggttaagtcttttacatttaataggttttttggaagacaatctaggttaagcaagagcaaagtgccattgtttgcctttaattggggggtgggaagggnaaanaagggtacttgccaca

SEQ ID NO: 30908 - DNA, 177 bp, Homo sapiens
  misc_feature 8, 16, 44, 47, 58: n = A,T,C or G
ccgggaanttcggccnttatggcccgggggaaggcgaagaactngantagagtaaganagggaaattagaagataaaaacatacttttagaagaaaaaagataaatttaaacctgaaaagtaggaagcagaagaaaaaagacaagctaggaaacaaaaagctaagggcaaaatgtac

SEQ ID NO: 30909 - DNA, 262 bp, Homo sapiens
  misc_feature 259: n = A,T,C or G
ggtgcaactgtgtctgtacaaaaaatacaaacattagccggtatggtggtgcatgcctgtggtcccagctactcaggaggctgaggtgggtgcattgcttgatcctgggaggtggaggttacagtgagccaagattgtgccacttgtactccagcctggcgacaaagcgagaccctgtctcaaaagactaagttaaaattgaaagtcttacaactggtaagtgacagaggtaggacttaaaatctaatgtgcacaaatnaga

SEQ ID NO: 30910 - DNA, 402 bp, Homo sapiens
agagggagtcaatgaagcctttgactgaatagactcaaattctggttctggaaattgatctttgatgataatgataggataactgcagggaagtcgtcttgacccattttcctccacagtcagtcttctgaaatgacactactgagaaatgcagtctttacatcatcttcattaagtacacaacaaaatgtctggcaatgttgtagactccagcgggacatggttagagaagaagtggttcagcagaagggagtaagctccaggtaaacatgcagcacaaatgaggaagaatttccaggacatggaaactaacgggtaagagagatgagctcagattggaggagctcacctcagcctctcaaaatgctaggattacagacatgaaccactatgcctggccct

SEQ ID NO: 30911 - DNA, 473 bp, Homo sapiens
  misc_feature 15, 432, 455: n = A,T,C or G
ggggcaatgaaagantaccagggagaaagacctaaaaattataagtgtaggtgattattttgtgattattccagggagaaagacttaaaaattataagcatagatgattttatagtaactaattagattacagggattataaatatatgcctatagggaaaaaaatatctcttctactactcctagtactaaaagtcacctaaaatgctggatacaatacaccaagcacgtgatttcagatgcgcagctgaaccaagaagaaaataagtaaaatctccagaaaggccaagaatgaagaaagacaggaaaccagaagaataatcaaatgctaaagttgcagcctgccctgaagttgttctctaaaatagaaacatgaaaccacttggggatcaggaaacaaggccttcggcctgaagaaggtagggaataggnatttgagattctccacacagagnggggaccctcaaagcaca

SEQ ID NO: 30912 - DNA, 354 bp, Homo sapiens
  misc_feature 8, 22, 61: n = A,T,C or G
ctcccccngggaatttcggccntttatggcccgggggcagtaccattgagctcctagagancagcgcccggggcaagtgagagcccggacgggcacctgggcgactctgtgccctcgctgaggaaaaataactaaacatgggcaaaggagatcctaagaagcccgagaggcaaaatgtcatcatatgcattttttgtgcaaacttgtcgggaggagcataagaagaagcacccagatgcttcagtcaacttctcagagttttctaagaagtgctcagagaggtgggaagaccatgtctgctaaagagaaaggaaaatttgaagatatggcaaaagcggacaaggcccgttttga

SEQ ID NO: 30913 - DNA, 473 bp, Homo sapiens
  misc_feature 4, 140: n = A,T,C or G
tgcnaatccacgttataaggtacttttaaggtattttagttgtcttagtctatatttctgtactcacctttctttatccactcatcagttgatgggcatgtaggttggttccatatctttgcaattctgaattgtgctgngatcaggtgtctttttagtataatgatttactctcctttgggtagatacccagtagtgggattgctagatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactga

SEQ ID NO: 30914 - DNA, 470 bp, Homo sapiens
  misc_feature 12: n = A,T,C or G
gcacctgcaganctgagcggtggaccgaattgggaccgctggcttataagccgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttggtgtgaggcaatcatggtggcatcacccataaagggaacacatttgacttttttttctcatattttaaattactac

SEQ ID NO: 30915 - DNA, 471 bp, Homo sapiens
ggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttc

SEQ ID NO: 30916 - DNA, 154 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgc

SEQ ID NO: 30917 - DNA, 473 bp, Homo sapiens
  misc_feature 472: n = A,T,C or G
agctgattctagggaaagcccttaaagggaatctccttcatctggaacttacattgcagcgtacatttcttgggaagcctggttgggttgaatttaaaaatggaaaattcaactagagattaagaatttgagtttttttgtgtgtgtctatacttaaaatttggtgtgtaatattatgctcacttttggaaaaagcaaagaacattgatttttctgggatgtaagttttccaacaaaattgcgctataggccatgcctggtggctcacacctataatcccagcactttgggaggccaaggtagatggatctaccttggtcaggagttcaagactagcctggccaacatggcaaaaccccatctttactaaaaatacaaaaattaggtggcatttgtggtgcatgccttgtagtcccagttactcgggactctgaggtaggatcacttgagcccaggagcggaagttgttaant

SEQ ID NO: 30918 - DNA, 467 bp, Homo sapiens
cggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttac

SEQ ID NO: 30919 - DNA, 381 bp, Homo sapiens
atttacctttctgtattaaccttggcctgtcctaaaaagagaacgactgtttcatcatgagttgctctgagttttgttaatgtttgtgttggtggattgacggttaaatgaagcatttagctggaatatgaactttgggagttttcatgttgtcctggatttctctttgtaaacctttaaaccttagcccctggttgattgtgttaaacccattatgagaatgttatttaaagttgtattataattgcaacctccactaattattcagtactgtagcagcaaagtattatttgtaagaatttggctatttttatacttatatccactctaagtctggcgttctagtcagtaaaatgatgcaataaaattaatatcattttc

SEQ ID NO: 30920 - DNA, 273 bp, Homo sapiens
ggcggtggctcacacctgtaatcccagcacgttgggaggttgaggcgggtgaatcacgaggtcaggagtttgagaccagcctgaacaatgtggtgaaaccctgtctctactaaaattggaaaaaattagctgggcgtagtggtggccacctgtaatcccagctactcgggaagctgaggcaggagaatcgcttgaacctgggagatggaggttgcagtgagccgagatcacaccactgcactccagcccaggcaacagagtaagactctgtct

SEQ ID NO: 30921 - DNA, 389 bp, Homo sapiens
aataaaagtgatatcaccaccaatcccacagaaatacaaactaccatcagagaatactgtaaacacctctatgcaaataaactagaaaatctagaagaaatggataaattcctggacaaatataccctcccaagactaaaccagggaagaagttgaatccctgaatagaccaatgacaggctctgaaattgaggcaatagttaatagcctaccaaccaaaaaagtccaggaccagacggattcacagccgaattctactagaggtacaaagaggagctggtaccattcgttctgaaactataccaatcaatagaaaaggagggaatcctccctaactcattttatgaggcctgcatcatcctgataccaaagcctggcagagattcaac

SEQ ID NO: 30922 - DNA, 254 bp, Homo sapiens
ggagaagtggtgggcaccgggtatgttcacaccctggttgtagactcgcaaaaggtgaatttcagaaggtgcgggagaaaataagaatgctgtgaacagagatggaggaggaatggaaagattttaaaggcaaaatttgtctgagtgcggtggctcacacctgtaatcccggcactttagggggccggggcgggaggattgcttgagcccagaaatttgagaccaacctgggcaacatagcgagacctcatctc

SEQ ID NO: 30923 - DNA, 287 bp, Homo sapiens
gagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacc

SEQ ID NO: 30924 - DNA, 450 bp, Homo sapiens
ggggaaagaaaataccgcctccttttgacaaaattgttggctttgttcagtcagggctgagattttgcaggtaaacctgggcggtgtggcacttcattgaatttattagttttgtattccaaggacattttatgaaaatatcaaatattctgaaaacttccatgcttgatttagaatttaaataaacactatgagacaactccttggtagagattgtttaaatttggaacacatactgactcttcccctgaatttttgagatcccctgagactggcattttacttctgtgttttaccagttggagtggagcaaccttcactaaaatctgtactgatggatttttgtaactttttaatgccatttaagaacataacacctttaaattaaaaatcttcaaaaggctcgtcattctgttcaagagaaggttcaatacatattcttctaattca

SEQ ID NO: 30925 - DNA, 368 bp, Homo sapiens
  misc_feature 32: n = A,T,C or G
gtcactacacataatgtaatctcccttctttngctcccccaacagtgagcacgcttcccaaaaaattacaacatcaaaaccaggaatgtccccgcatctactattaccaggcttgcaattggttcaattttcccataaaaacatgtttgtccaaaagaagggaaactgtgaatttattccatgcatgtaataaactctgcaagaagtttaacccacataggtttgcggcactgcaaaattgttcatgggtctatgtagcaaatgattctctgccttgacaatcatgtatacatatcaagatttctatcataatgataatggagattgatgacttcctgttttcctccaataaagacaattaatcacct

SEQ ID NO: 30926 - DNA, 100 bp, Homo sapiens
  misc_feature 5: n = A,T,C or G
tcccngggaattcggccttatggccggattgtctagttgtttttttcccccaagaacaaaggcaagtttccctaagtttgagttgatagttattaaaaag

SEQ ID NO: 30927 - DNA, 472 bp, Homo sapiens
ggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgt

SEQ ID NO: 30928 - DNA, 343 bp, Homo sapiens
atgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttc

SEQ ID NO: 30929 - DNA, 369 bp, Homo sapiens
aactcaatcccgtggaaggatgtggttaatatcaaataggtggtggatcattgaaaacgttaaatgttgattctttaattagcacctcctcaatcattttggaaaccccaaagtacttagtgaactcaacaggtgtatggtgttcaggtcaggaaaaacagatctagtaattaactgtcaccatcaaaaggctgggctttcttaggtcaacatgaagactagctcccatttccactaccacctgcactgtaataatttaatagattgaaatgctgagaatgctttgggtaattgtaaaaacatacagaaaggaacttgatttagtcctacccagaatcagaataataccctaaagagctcatttatctt

SEQ ID NO: 30930 - DNA, 251 bp, Homo sapiens
gaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttgg

SEQ ID NO: 30931 - DNA, 132 bp, Homo sapiens
ggaagaaggggaagaagattgatcaaactgaatgaaacccccacacacacacacatgcatacacacacacacacagccacacacacagaaaatatactgtaaagaaagagagaaaataaaaagttaaaaagt

SEQ ID NO: 30932 - DNA, 213 bp, Homo sapiens
gaactcaggagttaagaccgcctgggcagcatggtggggccccgtctctgcaaaaataaaaaaattagctggacatggttgcgtgtgcctgtggttccggctgctcgggaggctgaggcgggaggatgacttgagcatgggaggttgaggctgcagtgagccatgatggagccactgcgctccagtctgagtgacagagcaagaccccatctc

SEQ ID NO: 30933 - DNA, 473 bp, Homo sapiens
  misc_feature 13: n = A,T,C or G
attccataaaatnaagtggctttagtcttcctgagaagtccttatccacgcagattttagtgataacactcagagttggcgctggtggatagtacctacgctgggcctttgtagaaatcacactggcagtgtgcgtaaggaaatctaaatggcaccagtctttttactttctacaagtctgtcctggggaaataatctgaactgcaatccagatatatctataagcatatttattattataacattatttagagaatcagagaattacaaactatttccaatgtaatttccaattacaaacaatgtccaatatagggcagtggttaaatctagtcataatggtaatagtacgcagttaccaaaactatgttttcagagaatatttgtaagaaaaatactcatagtatgttatatgttaatataatataccaaatggaaaattgccagtaatccttagttttaggaaaagagat

SEQ ID NO: 30934 - DNA, 443 bp, Homo sapiens
gatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagttagaaagaaaca

SEQ ID NO: 30935 - DNA, 329 bp, Homo sapiens
  misc_feature 2, 23, 33: n = A,T,C or G
tntatggcccgggcttaaagacntgatcaatantgtaaatactgtgatttgaaccttggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactactatttaatattttgaataagattttaaaaaataaatggcaaagatat

SEQ ID NO: 30936 - DNA, 220 bp, Homo sapiens
  misc_feature 10, 11, 30, 43, 55: n = A,T,C or G
aatttcggcnntttatggcccgggattctnagcgaagtacctnaggaatggaaanccaaacatcgtacgttctcacctcataaatgggagctaagcctaggaggatgcaaaggcataagaatgacacaatggactttggggaatcaaggggaaaggaagggaagggggtgagggataaaagactattaattgggtgacagagtgagactccgtctcagcg

SEQ ID NO: 30937 - DNA, 264 bp, Homo sapiens
  misc_feature 11, 263, 264: n = A,T,C or G
attgacattgnacccctggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcnn

SEQ ID NO: 30938 - DNA, 212 bp, Homo sapiens
  misc_feature 5, 11, 28, 54, 56, 64, 90, 91, 96, 129, 138, 161: n = A,T,C or G
agganccggantgccggggtccgaagancctgatgggccggcatttgggaaaancnctgatgcnagagtggcggcaccccttttggcacnnttcantggccattgggatgggcatcccgatgctaaccnatggttgcnaactacatctgtccctttcccantcaaatcccagccccatgtactaaataaaaagaaaagtctttgagtagccg

SEQ ID NO: 30939 - DNA, 500 bp, Homo sapiens
  misc_feature 4, 15, 28, 33, 34, 50, 52, 78, 79, 85, 86, 87, 105, 140,187, 196: n = A,T,C or G
tctntggcccgggtntttgataaacttnaaccnnccccttctgatgtaantncccctaaaaaacctggatactagaanngagaannntctcaaccctaaccaaangcccacactactgaacagaaccccacagctagtantcctacctaaaactggagaaaagatgaaaagtctttccctctaagantctagaacntgagaaggatgtccactggtcacccagtgttacctcaacatagtaatggaagtcctagctagagcaatcaaacaagagaaagatataaagggcatccagattggaaaggaagaattcaaattatgcttgtttgcagatgatatgatgttatatttggaaaaatctaaggactccatcaaaaaactattagaactgataaattcaataaagttgcataatacaaaaccaacacacaaaaatcaaaatcagtagcatttctggatgggcacagtggctcatgcctataatcccagcactttgggag

SEQ ID NO: 30940 - DNA, 335 bp, Homo sapiens
  misc_feature 3, 5: n = A,T,C or G
aancnaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtgg

SEQ ID NO: 30941 - DNA, 438 bp, Homo sapiens
  misc_feature 7: n = A,T,C or G
gctttcnacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtgggatgagaactaatcgctgatcgtcagatcaaataaagttataaaattg

SEQ ID NO: 30942 - DNA, 288 bp, Homo sapiens
  misc_feature 13, 14, 27, 34, 36, 37, 47, 49, 53, 57, 58, 66, 67, 76, 87,164: n = A,T,C or G
tgggcccggggannccaaaactgaacntacctancnntttaccgacnangtangaannagggtacnntgtttcccnaagggcagggngggcttgtgaaacctttccctctgagtgaaggcattccccccttcccagcacccttttcagccctgctagttaggancgaccccgccgccaccccttccaggaacctccagcccctgcactgcccttttccctctctttttaaataattcttcattgagttctaatatgtaaaaaaaaaaaaagtttactgtaaagtttgc

SEQ ID NO: 30943 - DNA, 497 bp, Homo sapiens
  misc_feature 14, 24, 30, 32: n = A,T,C or G
attggcccggggancctgcaggancgaaancnatgaagagccctgatccttcttgccattcctggcccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcc

SEQ ID NO: 30944 - DNA, 290 bp, Homo sapiens
  misc_feature 8, 23, 31, 46, 55, 79, 86, 96, 97, 103, 167, 178: n = A,T,C or G
tgggggangtaggaagtagtccntgtggganctgagcccccttgancctgtgganttcctgacctccttaacctcaaanaaagacnagtgttagannttaaanttgaattactagggtaccccagttggtgtcctcttagagtatttgcttgatgtgtggagaaaanctcccttcacntttagttgtagaaagtattctacattgagtgtgagagtagagagagaaaaagagtttttttaccccatagtgtaggaattttgcatggtcaccccaaattaaaataatgacc

SEQ ID NO: 30945 - DNA, 119 bp, Homo sapiens
  misc_feature 119: n = A,T,C or G
attgaaattaaaaagtggaatttgtcctaaagaatttcttttatttttgaaatcgagtttgtaaatgtccttttaagaagggagatatgaatccaataaataaactcaagtcttggctn

SEQ ID NO: 30946 - DNA, 239 bp, Homo sapiens
  misc_feature 1, 11, 39, 41, 66, 73: n = A,T,C or G
nggcccgggcnaaggagcttggaagtgctgctgatgtgnancaaaatctttacctgtgcccgagancgctcanaatgtttcctcccaagaaacccgcaaagcccattcgtggaaagagcctgccccaacctggcccatcagaagtcacccaacccccaatgcccaggcttgcgcagtgaaagaaaatgagtaggcagcctcatgtgcacgttttctgtttaaataaatgtaaaaactgc

SEQ ID NO: 30947 - DNA, 157 bp, Homo sapiens
  misc_feature 5, 9, 66, 69, 74, 79, 105, 112: n = A,T,C or G
gtgantganaccaaccgtgttaaactgggttcattaagccagtactcctcgtgcctcctggggganctnctganttacnaagtgtgttgatggcaagggcccaancagaaanaacttgtttctccagagcctgaggtttattgaaattttaagagcc

SEQ ID NO: 30948 - DNA, 355 bp, Homo sapiens
  misc_feature 9, 12, 32, 41, 255, 256, 270, 289, 308: n = A,T,C or G
tgaaaagcntcntttgaggagtctcccaaccnttgtagaanaaggaagagttgtgttttctagaccaagaaccccggaggggagaagaagaaaatgtggtgcagtcttagcctaaaatagttcctaacattttggtgagagagggcccacaaacattatgtaaacaggggtttaggttttctcctgcagatattgggagccatttaaaaacgttagttagcaaatgcccgtaacccagaattttttttttttgannccccctctgattanatggcagtatcagggatanattgaatttttaaaaggtngcaagcatgtttagaggcttttcaatcattctggcaagaaattaaat

SEQ ID NO: 30949 - DNA, 407 bp, Homo sapiens
  misc_feature 16: n = A,T,C or G
gaaatctccaaactgnagacaaatgctatggatgggctagtaaacttgaccatgcttgatctctgttataattatcttcatgattctctgctaaaagacaaaatctttgccaaaatggaaaaactaatgcagctcaacctctgcagtaacagattagaatcaatgcctcctggtttgccttcttcacttatgtatctgtctttagaaaataattcaatttcttctatacccgaaaaatacttcgacaaacttccaaaacttcatactctaagaatgtcacacaacaaactacaagacatcccatataatattttttaatcttcccaacattgtagaactcagtgttggacacaacaaattgaagcaagcattctatattccaagaaatttggaacacctatacctac

SEQ ID NO: 30950 - DNA, 193 bp, Homo sapiens
  misc_feature 80: n = A,T,C or G
gactgctccgggtgtcggctccggcgggacgggcggttctgcgtacccctctccgatcctgattgagtcaatgctttgcnttctcggtcctctgcataaagctgagagatgcctacagctgagagtgaagcaaaagtaaaaaccaaagttcgctttgaagaattgcttaagacccacagtgatctaatgcgcg

SEQ ID NO: 30951 - DNA, 226 bp, Homo sapiens; identical to SEQ ID NO: 14144

SEQ ID NO: 30952 - DNA, 148 bp, Homo sapiens
  misc_feature 22: n = A,T,C or G
ggtagtcgcccgtgccctaccntggtgaccacgggtgacggggaatcagggttcgattccggagagggagcctgagaaacggctaccacatccaaggaaggcagcaggcgcgcaaattacccactcccgacccggggaggtagtgacg

SEQ ID NO: 30953 - DNA, 471 bp, Homo sapiens
  misc_feature 418, 420, 443: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagtttaaaagttgnanggtgattaaaataattttggaanggcgatcttttaaaaagagattaaaccg

SEQ ID NO: 30954 - DNA, 105 bp, Homo sapiens
cagagtatttttttaaaaagtatttacccacattaataataaaaggtgtataagttaaattcatgagtttgtttctcagttatttaattaacaaaggttgaaggc

SEQ ID NO: 30955 - DNA, 476 bp, Homo sapiens
  misc_feature 14, 370: n = A,T,C or G
ggggtgattttttncgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagnatggtgacattcttggaaagtacgtagactgaaataagtcactattgaaatggcatcaacatgatgctgcccattccactgaagttctgaaatctttcgtcatgta

SEQ ID NO: 30956 - DNA, 418 bp, Homo sapiens
caatacataatgtacacctagcttgccgagctctatattatgatgccaggtaacccacagtgtggactccactgtatatatgaacatcacatgcataaatgttaagcacagatagcacatatggaaaaatttgaaatgagctaaggttaaagaagatgctaaagagcaggtaccaagaaatctcagaaagcggactgaagtgttaaataaagaatgtttggcttgggaagcaatctgggcttaaattgaatgcattttatttagtgactggaaatttttgaagttcaaaaattttttaaaaacagttatgttagaatagactctgtatctgaattcttgatactaatgaccttataacaagttgggtttgatcccattcacttgagccagttggttttttgtaagtgaatttctcatt

SEQ ID NO: 30957 - DNA, 480 bp, Homo sapiens
  misc_feature 330, 470: n = A,T,C or G
gcatgcctgcaggcatgcatgccaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaagacaccaaacttggcagagaggtggaaaatcagtcatgattacaaacctacagaggtggcgagtatgtaacacaagagcttaataagaccctcatagagcttgattcttgtatattggatgttggncttttctttctgtatctgtaggtaaatctcaagggtaaaatgtttagggtgtcagcttttcagggctctgaaaccccattccctgctctgaggaacagtgtgaaaaaaagtcttttagggagatttacaataatctggtncttttgctca

SEQ ID NO: 30958 - DNA, 217 bp, Homo sapiens
taacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtaccccacgtaaagacgttaggtcaaggt

SEQ ID NO: 30959 - DNA, 482 bp, Homo sapiens
gagtgacttccaggaaatggctacccaacttgccttcatgcgccctgctggccaactatgccctctcagaacatcacctaccactgcaagaacagcattgcatacatggatgaggagactggcaacctgaaaaaggctgtcattctacagggctctaatggatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcac

SEQ ID NO: 30960 - DNA, 375 bp, Homo sapiens
  misc_feature 5, 6, 37, 46, 52, 53, 61, 62, 96: n = A,T,C or G
cggcnntttatggcccggggccttttccggcggtgancggccctancgccanncgagtaanntgccctctcgcaaggatctccttcatccctctcnagaagaggagaagaggaaacaccaagaagaaaccgccctggtgcagggcccccaattcctacttcatggatgtgaaatgcccaggatgctataaaatcaccacggtctttagcccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggac

SEQ ID NO: 30961 - DNA, 471 bp, Homo sapiens
  misc_feature 5, 6, 34, 37, 41, 42, 43, 57, 71: n = A,T,C or G
cggcnntttttggcccggggtaaaaaccctgaanccngaannnacacaatccgttgnaaaccccaaaggancccaagtactttccaatctcagtcacctctaggactctgcacctgaatggctgaccctgaccctgatgtccattcatcccacccctctcacagttcggacttttctcccctctctttctaagagacctgaactgggcagactgcaaaataaaatctcggtgttctatttattttatttgtcttcctgtaagaccttcgggtcaaggcagaggcaggaaactaactggtgtgagtcaaatgccccctgagtgactgcccccagcccaggccagaagacctcccttcaggtgccgggcgcaggaactgtggtgtgtcctacacaatggtgctattctgtgtcaaacacctctgtattttttaaaacatcaattgatattaaaaatgaaaagattatttgggg

SEQ ID NO: 30962 - DNA, 467 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatcttttaaaaagagattaaaccg

SEQ ID NO: 30963 - DNA, 293 bp, Homo sapiens
  misc_feature 10, 11, 28, 31, 33, 100: n = A,T,C or G
aatttcggcnnttatggcccggggaatnaananttcccgagttgtctttttctgctttcaaaagtgtaatgatgtacttatttcctgctaaactttttantaaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtc

SEQ ID NO: 30964 - DNA, 351 bp, Homo sapiens
  misc_feature 10: n = A,T,C or G
agccctttcnaaagaaatgagggcatgattattgtacagtaagtacgtgactgatttaatttgatttacagagcggagtgtgttcttataaaaatatttaatgacattggttcttgtcttttgatcttttatttctgaaacactcaaacaccttacaaagtgctgagtaggtaatagtgacccaacttgtttgctaaatgattatttgtttaaatctgtacagttttaagtgttcacttatacaaagagtgtatatactttcaaataatttaaaatgctttatattatttggctagaaattgctgtttttaataaatgtgaattttttaaaaataaagatttttgcttcct

SEQ ID NO: 30965 - DNA, 471 bp, Homo sapiens
  misc_feature 4, 63: n = A,T,C or G
gacncacaacctcctggccgtggtggctgtggtgctgtcatctgtctgtctgctggtcatcgnggggcttctcatgtttaggtaccataggagaggaggttatgatgtggaaaatgaagagaaagtgaagttgggcatgactaattcccactgagagagacttgtgctcaaggaatcggctggggactgctacctctgagaagacacaaggtgatttcagactgcagaggggaaagacttccatctagtcacaaagactccttcgtccccagttgccgtctaggattgggcctcccataattgctttgccaaaataccagagccttcaagtgccaaacagagtatgtccgatggtatctgggtaagaagaaagcaaaagcaagggaccttcatgcccttctgattcccctccaccaaaccccacttcccctcataagtttgtttaaacacttatcttctggattagaatgc

SEQ ID NO: 30966 - DNA, 288 bp, Homo sapiens
  misc_feature 51: n = A,T,C or G
gaggcattgaggcagccagcgcaggggcttctgctgagggggcaggcggancttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagt

SEQ ID NO: 30967 - DNA, 476 bp, Homo sapiens
  misc_feature 16, 58: n = A,T,C or G
ggatcttctatcttcnattctaaatccgacttgaatattcctggacttacaaaatgcnaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatataccctgggtttacttctttagcatttttatgcagacagtctgttatgcactgtggtttcagatgtgcaataatt

SEQ ID NO: 30968 - DNA, 242 bp, Homo sapiens
ggaggctgaggcaggtagatcacctgaggtcaggagtttgagaccagcctggccaacatggtgaaaccccgtctctactaaaaataacaaaaattaactgggcatggtggcacgcgcctgtaatcccagctagtcaggaggctgaggcaggagaatcgcttgaacacgggaggcagaggttgcagcgagccaagattgtgccattgcactccagcctaggcaacagaacaagactctgtctc

SEQ ID NO: 30969 - DNA, 341 bp, Homo sapiens
  misc_feature 13, 21, 37: n = A,T,C or G
tggcccgggtctnataaaatngactagtatttggccnttaaaagaaggaagtagggccaggcatggtggctcatgcctgtaatcccagcactttgggaggccgaggtgggcggatcacctgaggtcaggagttcgagaccagcctggccaacatggtgaaaacccatctctactaaaaatacaaaaattagccaggcatggtggtgcacgcctgtaatcccagctactcaggaggctgaggtatgggaattgcttgaaccagggaggcagaggtagcagtgagccgagagcgcaccactgcactccagcctgggtgacagagcgagactccatcccccccc

SEQ ID NO: 30970 - DNA, 124 bp, Homo sapiens
cagatgaaagtgaagaagatccgccatctaatgatgacagtgacactgacttttgtagccgtagactgaggcgacacccctctcggccaatgaggcagagcaggcgtttgcgaagaaagacccc

SEQ ID NO: 30971 - DNA, 473 bp, Homo sapiens
gtgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaactggccccacatgaagagaacatcccttgagacgaatt

SEQ ID NO: 30972 - DNA, 457 bp, Homo sapiens
gcaatcaaggaagtctaggatgtgaacagtttgccctactgcactggcggattcctgccctggtgaagtgaggagcagagaggagaaggggtggccagctctgtttattaaccagttatttactaggtgctttagtacaggcttctcaaacattcgtgtatatatgaatcacttgagatcttgttaaaatgccagttctgattcagtggggctagggtgaggcctgagattctgcatatctgaaaagatcagctgatgctaatggctgttggttcaaggaccaccctttgagtagaggtgggttagtgtaaacattccttggtcttagatgctggtctcagggagaggcttaaaactaaccctggaagacctagatcccttgcccagaaggggtttttagtcgaatgaagagagatcaagtaatgcacaggaaatgatttagaagataaattaagtg

SEQ ID NO: 30973 - DNA, 480 bp, Homo sapiens
  misc_feature 1, 23, 29, 36, 43, 88: n = A,T,C or G
ngggagatcgcggtcgggtgtgngcctgntggtggnggggaanatggtcagtaggacagaaggtaacattgatgactcgctcattggnggaaatgcctccgctgaaggccccgagggcgaaggtaccgaaagcacagtaatcactggtgtcgatattgtcatgaaccatcaccctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatgggttagaaatgggaaaaatgttaaccaaatgtggcaaattat

SEQ ID NO: 30974 - DNA, 323 bp, Homo sapiens
  misc_feature 2, 322, 323: n = A,T,C or G
cnccctctccccttttacaaaaatcactcagatggatcaaagccttaaatctaagacctgaaatgataaaaattctaggagataaccctgcgaaaaactcttctggacattgacctggcaaggaatttatgactaagactccaaaagcaaattcaacaaaaacaaaaataaataaatggtaccctaattaaactaaaaaccttctgaacagctaatcatcagagtaaacagaaaacacaagaatgggagaaaatatttgcaaactatgcatctgacaaagaactaatatccagaatctacaagaaacacacacaaatcagcnn

SEQ ID NO: 30975 - DNA, 476 bp, Homo sapiens
  misc_feature 31: n = A,T,C or G
atagcaaggactaacccctataccttctgcntaatgaattaactagaaataactttgcaaggagagccaaagctaagacccccgaaaccagacgagctacctaagaacagctaaaagagcacacccgtctatgtagcaaaatagtgggaagatttataggtagaggcgacaaaccctaccgagcctggtgatagcctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaact

SEQ ID NO: 30976 - DNA, 326 bp, Homo sapiens
gggtagaatgctggccgattatcgagccagaggaggaagaatccagcccaaaaattcagacccttttgctcattcaaaggatgcatcaagtacttcaagtggcaaatcaggaagcaaaaacgagggtgatgaagagagagggcttattctgagtgatgctgtgtggtcaacaaaggtggactgtctgaatcccattaatcaccagagactttgtgtgctcttcagcagctcttctgcccagtccagcaatgctcctagtgcctgtgtcagtccttggtaggattcttttccccctacactattccacataagaacagaattccagc

SEQ ID NO: 30977 - DNA, 207 bp, Homo sapiens
  misc_feature 2, 16: n = A,T,C or G
cngggaatttcggccnttatggcccggggtctctactaaaaatacaaaaattagctgggcgtggtggcgcacgcctttagtcccaggtacctcgggaggctgaggcatgagaatcaatcgaacccgggaggtggaggtggaggttgcaagtgagccaagatcgcaccattgcacttcagcctgggcaacagagcgatcttctgtccc

SEQ ID NO: 30978 - DNA, 140 bp, Homo sapiens
ataaatagaattacctaaaccactactggatatatattccaaaaaattgaaatcagtacattaaagagatgtctgcatgcccatgtgcattgcacctttattcacaatagccaatatgtggaatcaacctaagtgtccat

SEQ ID NO: 30979 - DNA, 331 bp, Homo sapiens
  misc_feature 13, 24, 43: n = A,T,C or G
tacctagaatgtnagatgtttttnagttatctccccatttgtnaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaaatattgcaaaataaaatccatctaaat

SEQ ID NO: 30980 - DNA, 435 bp, Homo sapiens
gagatgagatgaaatgagatgaaatgatagatgagataaaatgatatgaaatgatgagatgaatgatgagatgatgagatgaatgatgaaatgatgagatgagatgatgaaatgaaatggtgagatgaaatgatgagatgaaatgaaatagtgaaatgaaattgaaataaaatcgaaatgagatgaaatgatgagatgatgaaataaaatgatgaaatgatgagatgtgatgagatgaaatgatgacatgaaatgatgagatgagatgagatgacatgaaataatgaaatgaaattgaaatgagataagatacgagatgagatgaaatgatgagatgaaatgatgaaatgatgagataagatgaaaagggttgagatgatgagatgaaatgagatgaaaagatgaaatgatgagatgaaatgaaatgatgagatg

SEQ ID NO: 30981 - DNA, 185 bp, Homo sapiens
ggtgaaaccccatctgtacaaaaatacaataattagatggatgtggttgtgtgcttctgtagttccagctactcgggaggctcaggtgggaggatcatttgaacctgggaggtcaaggctgctagtaaccaagattgtgccacttgtactccagcctgggcaacagaatgagaccctgtccccga

SEQ ID NO: 30982 - DNA, 159 bp, Homo sapiens
  misc_feature 1, 31: n = A,T,C or G
ngactcttagacggtggatcactcggctcgngcgtcgatgaagaacgcagctagctgcgagaattaatgtgaattgcaggacacattgatcatcgacactttgaacgcacttgcggccccgggttcctcccggggctacgcctgtctgagcgtcgcttc

SEQ ID NO: 30983 - DNA, 462 bp, Homo sapiens
ggaaggagtacatcgtctagtgagggacagaccaagcacgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgcc

SEQ ID NO: 30984 - DNA, 467 bp, Homo sapiens
  misc_feature 24, 433, 445: n = A,T,C or G
gtttttttaaagagaaaacaaagnaatcctggtttttatgtgaaatctctaattttaaaataataactcattaaaaatattgtaatgtccaaaagtatctttccatttaacttctaaaaatctcttaaatgttttttttaaataattgtaaagtgagtttttgttaagcttataggaatgggccagttaactaaggtagacagatgtaggaaattaaatatttgatttacttagggatctatatgacatcagttatcaaagaatacattttaacccaaaagtataccatgctcattgtatctttgatcgtccttcaagtatttctcaatcttttaatctatcaggaacattactatcaagagcagattgttgtaacataatactcaggatacatgaaatgtttgtgagagataaatagataatttggaaaggnttttttggtatnaaaaatgacctacaacttatat

SEQ ID NO: 30985 - DNA, 466 bp, Homo sapiens
gactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgcca

SEQ ID NO: 30986 - DNA, 201 bp, Homo sapiens
  misc_feature 7, 13: n = A,T,C or G
atttttngcaatnaagtaaactttcttaaaagcttttaacacttgagcaagtcttaaaaatatgaacaaaaattgagacatgtttgtttctctgcctagttactctagaatttgaaaagtagttatgaatattattaaattaaaacaatatggttgtttgcatcagtgcaacaagaatccattttcttttacaacacgatg

SEQ ID NO: 30987 - DNA, 261 bp, Homo sapiens
ggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgaccccattgagaatgtcaaggcaaagatccaagacaaggaaggcatccctcctgatcagcagaggttgatctttgctgggaaacagctggaagatggacgcaccctgtctgactacaacat

SEQ ID NO: 30988 - DNA, 371 bp, Homo sapiens
  misc_feature 2, 6, 44: n = A,T,C or G
cncccngggaattcggccttatggcccggcagaggaatgaagtnactttcgaggtgacataggcagtgagtggcagatctggtactgggactccatcttcctgggctgggaatgtgcaggaagggagagttgaaaggtgacaagggaggagaagggagacaccatttctagggcttttctcctctatctaccaagtacctgctacctacgtacttggacatcttgactagagtttgatgaaagaaaacagcactccctaatggaaaacattatctctcagttgtttatacagtctagtaaattattttaatgtctctgtagtttctctttttttgttttgttttgttttgtgacagagcaagactctgtct

SEQ ID NO: 30989 - DNA, 471 bp, Homo sapiens
gaggcaggagaatcgcttgagcctgggaggtggaggctgcagtgagctgagatcacgccattgcactccagcctgggctacagagtgacactctggctcaaaaaaacaaaacaaaaaacaacgactcaggccaagtctacatggggatggactgacctgcattatgccaaagagggcaaacgttcctccctacgtaggggaaagtgttaccacactagcccttctgtttctagcccacttccttttctatgatatatttttatagacatagtcaccttcccataggctcagggaacaagtgacatttgcctagcctttttctttgtttcagatgaagtaaccaagactgaggacagagagttggtgctaaggaaagactgtcctaagatagtggaaccacatgggaaaatgtttaatgagcagacctgggaggtatcacagcaggatccctcacatgggagaagttggtga

SEQ ID NO: 30990 - DNA, 124 bp, Homo sapiens
attcttggatgggaagacccaatatggtagaaatgtccattttctcccaaattactccctacatttattctgatttattcaaaaattcctctagcctgggcgacagagcaagactccgtctcag

SEQ ID NO: 30991 - DNA, 203 bp, Homo sapiens
  misc_feature 8, 10: n = A,T,C or G
gagggggngngccacgtgcacccggccctacaaaaaaacttttgaatatttagcccatgggggggcgcacctattagttccagctactcaggagactgaggtgggaggatcgctcagctcaggagttcaagactgcagagagctatgatcattgtgtcactgccttccagcctgggtgacacagcaaaacctggtctctactg

SEQ ID NO: 30992 - DNA, 325 bp, Homo sapiens
  misc_feature 100: n = A,T,C or G
taccagcagaaaggttagtatcatcagatagcatcttatacgagtaatatgcctgctatttgaagtgtaattgagaaggaaaattttagcgtgctcactngacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtg

SEQ ID NO: 30993 - DNA, 310 bp, Homo sapiens
  misc_feature 16: n = A,T,C or G
gtaaggacctcacgcntccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatc

SEQ ID NO: 30994 - DNA, 356 bp, Homo sapiens
agcgacgcaagatggcagccaccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatat

SEQ ID NO: 30995 - DNA, 446 bp, Homo sapiens
  misc_feature 10, 22, 32, 34, 41, 44, 46, 52, 54, 56, 62, 75, 76, 77, 78: n = A,T,C or G
cataatgcgnctttagcactcngtctagctantntgtgccngcntngactgngngntaactngcacatttagcannnnggagtgggaggaaccactacatttagaaaaggagaaggagagaatcaaggtgtaagttgtcaatggtactaagtacagagcccattctgcctgggagatttagtggcaactcacttcccatgaaataaagcaagttctttgtgtagccagactgagtgccacagcttcaggtcctcttgccggggaataacccttgcccagtattggcacagtcataaatgttaacatagttaaatggtactcaactgttaagcaatcccatgccattctgccagacttaaagtgtctctggaaatacagctttttaaaaattccactcagatctgtattgctttcatttgagacaatctcctaactggaaaccaatt

SEQ ID NO: 30996 - DNA, 321 bp, Homo sapiens
  misc_feature 8, 14, 28: n = A,T,C or G
acccccgncccttntggcggggctacgnccatcatttgtttctaagttgtgttttttcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaag

SEQ ID NO: 30997 - DNA, 250 bp, Homo sapiens
  misc_feature 40: n = A,T,C or G
tatggccgggagtctcatgtggtgcttgtagctgtgtctncgtagagctcagtaaatagttctacagggtttagaggatgagaagcgattgtcaaattaggctgaattgtagaacacaaataatttaattcaaaataacttaccaattttatatacatgataaagtattcagacaactttctaaatgcataatagtaaaagattgtgaccagatattatgatattaataaagttaccagatactaaaatc

SEQ ID NO: 30998 - DNA, 482 bp, Homo sapiens
aactgcccggtagccaaagaaagcttatttttcagtttgggaagagggataaaagtacttagcctctggcccagctcactggttatggactatctcctctgtgatttaggagcaaggaagaaaacaattctctgcaaatagaagttttggaaaatgatttgtgagactatttataattattacaaacatgtataaagttagcaataactttaatagtacctactatcaagttcttagcctagatcagaggttggctaacgttttctgtaaagggccagatactagttacaggccgtacagactctggcaagatacaagttacaggccattcaactctgttgtcatagtgaaagctacatatttaatatttaaattgaatagatgtggctctgttccagtaaaactttacaaattaggtggcttgaagcctgtggatagtagtttgaagacccctaacatagatctttttaatgttagagtga

SEQ ID NO: 30999 - DNA, 323 bp, Homo sapiens
  misc_feature 183: n = A,T,C or G
ctaggaaaaaaccttgtagaggagcagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagnataagtaacatgaaaacattctcctccgcataagcctgcgtcagattaaaacactgaactgacaattaacagcccaatatctacaatcaaccaacaagtcattattaccctcactgtcaacccaacacaggcatgctcat

SEQ ID NO: 31000 - DNA, 340 bp, Homo sapiens
  misc_feature 2, 14, 34, 37, 41, 42, 57, 59, 62, 65, 71, 74, 80, 82, 84,90, 92, 93, 97, 100, 102, 274: n = A,T,C or G
gnagaagcccggcngtgtggctggaggggacttntgnactnnatcaagcttatgcgngnggncgnggttcnagntcactngntnactacncnntatngtnancccttatgggagaccaacctcgtgcctccgggagatccactctcccacctggaaacgcacgggaagccaagcctccaaaaaagcgctgcctcctcgctccgggttgggattatccggaaggaactcccaacggaggtagtaccactctaccctccgcacctcctcctgcatnagccggcctgaagtcgcaccctcctcctccggagaagtagagaaataaatttctcccaccctaaac

SEQ ID NO: 31001 - DNA, 485 bp, Homo sapiens
  misc_feature 1, 2, 38: n = A,T,C or G
nntggccgggccttccattgagattgccacctacaggntgctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctccagttcttaacaaccgacactcctacaagatttagaaaaaagtttacaacataatctagtttacagaaaaatcttgtgctagaatactttttaaaaggtattttgaatactatt

SEQ ID NO: 31002 - DNA, 389 bp, Homo sapiens
  misc_feature 7, 32: n = A,T,C or G
cacaacngaaatggagcccggttgggatgatnttgtgagagaaagaaatgaatctaatccataaggctttgtagtacaagattgaaaaactcaacaagaatttaattctaaaagcaaaaattggtttgagttttcaagtttactaatttggattgtgagaaagtaccaagtaccagccgtccaaactgatcacaattaaaattctgacagttgccttttttttcatctcaaatggcagcatgggactgaaacatgagaatgccaccttttttaaaacttagtttagtgacaaagtcattgtcttttatgatatagttaattttaaagagatttagtattaatgtgagttgaatttgcagtctgttttttaggtgttctgaagataaatg

SEQ ID NO: 31003 - DNA, 249 bp, Homo sapiens
gaaatggaagatgcaccaaaacaaaagctttctaaaaaacagaagaaaaagaaacagaaaccagcacagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaagtgttcct

SEQ ID NO: 31004 - DNA, 174 bp, Homo sapiens
  misc_feature 108, 109, 163: n = A,T,C or G
tactgaaatacataggcttatatacaatgcttctttcctgtatattctcttgtctggctgcacccctttttcccgcccccagattgataagtaatgaaagtgcactgnngtgagggtcaaaggagagtcaacatatgtgattgttccataataaacttctggngtgatactttc

SEQ ID NO: 31005 - DNA, 255 bp, Homo sapiens
  misc_feature 6, 31, 34, 134, 150, 241, 252: n = A,T,C or G
ggaacncctgacgccctgcgccaggcaaagnttnagtccactgagtaccggagacaggtgcagtccctcacctgtgaagtggatgcccttaaaggaaccaatgagtccctggaacgccagatgcgtgaaatggnaagagaactttgccgnttgaagctgctaactaccaagacactattgggccgcctgcaggattgagattcagaatttgaaggggggaaatgggctcgtcacctttcgngaaatcccaanaac

SEQ ID NO: 31006 - DNA, 211 bp, Homo sapiens
  misc_feature 8, 24, 131: n = A,T,C or G
gagactgnctgtgacaagaacagngcggcgaagacctgcccccatgatcgaattacctcccaccagctccctcccacaacacatgggaattcaagatgagatttgggtggggacacagccaaatcatgtcntgtgagttaggaagaaatctaaaccagcatatcaaacaaacctagggtttcacaaatattgcttaggatgaggtgaggtt

SEQ ID NO: 31007 - DNA, 481 bp, Homo sapiens
  misc_feature 480: n = A,T,C or G
cgcttcccttctctttcattatacaaatggtgtatgcgtgcctatgataaacagttccagaagttgaaaacaatgatatgaatctctgccccagatagattctgtctttagatgtctccatcactgcaccagctccctttcccttcacatcctgtgtcattcagagctgggagttcagccaatcaacagtatctactaggtgtctgctgttctgggtgctggagatactgtggtgaatcaaacatgctgataaacacaggagaggttaacagagaataaactggacctggcctctcccttaactctgtctctgccatcaagtaagacaggcacagaatgctgacaggtggcttgggcacgtgggagtccttgacaaaagcagtgaagatggagtggaagttgtgactcttcctgcacatgcatttaattatacaacacacaagtattaaaagcttaatgtttgccagtcactgtgctggnt

SEQ ID NO: 31008 - DNA, 497 bp, Homo sapiens
  misc_feature 8, 15: n = A,T,C or G
tcccccgnctctttntggcggggaagagccattgaaacaaaaatacaatagattttcaaaataagaagttagttttcataagatacaagtgacaaacctctagccagaccaactaagaaaaaaagattcaattaaataaaatcagaaatgaaaaaggagacattacaactgataccaccgaagttcaaagtctaattagagactactatgagcatctatatgcaagtacattggaaaatctggaggaaatgcaaaaattcctagacagatacaacctatccagattgaaccatggagaaatctaaaaccctaaaacctgaacagaccaataagaagtaatgagatggtagccataataaaaaatctcccagcaaggaaaagcccaggacgtgatgtcttcactgctaaatttttaccagatatttgaaaaagaattgataccagtcttattgaaactattctgaaaaagagaagaggagggaatcttttcaaatgca

SEQ ID NO: 31009 - DNA, 496 bp, Homo sapiens
  misc_feature 419, 462, 477: n = A,T,C or G
caattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacattgtggtctcagatacttgggaggctgaggtgggagggttgatcacttgaggctgagaggtcaaggttgcagtgagccataatcgtgccactgcagtccagcctaggcaacagagtgagactttgtctcaaaaaaaaagagaaattttccttaataagaaaagtaatttttactctgatgngcaatacatttgttattaaatttattattttaagatgggagcnctagtcttaaattgnataaaatatcccctaacat

SEQ ID NO: 31010 - DNA, 276 bp, Homo sapiens
  misc_feature 6: n = A,T,C or G
catggngactcagacctgtaattccagcactttgggaggccaaggtgggaggatcacttgaggccaacagttcaagacgagcctgggcaacatagcaaggccttgtttcatcagaaaatttaaaaaattatctggggttggtggcacacacctataatcccagctacttgggaggccaagacagaaggatctcttgagctcaggaattcgaggctgcagtgagccatgattgcaccactgcactccagtctgggcaacaaagtgagactcttgtct

SEQ ID NO: 31011 - DNA, 251 bp, Homo sapiens
tgcctgttttcatctgtaaatagctaagtatgtacacgaggcgctacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagaggg

SEQ ID NO: 31012 - DNA, 462 bp, Homo sapiens
tcaaaaggaaagaagaaaaagggcccaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaaga

SEQ ID NO: 31013 - DNA, 382 bp, Homo sapiens
  misc_feature 6, 24, 216: n = A,T,C or G
tagatnaatcagtgttaaaagaantaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagctngggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctag

SEQ ID NO: 31014 - DNA, 316 bp, Homo sapiens
  misc_feature 31: n = A,T,C or G
gattccgtttcagcctccagctattatcttnatctatgagagtgaaatcaaggggaaaattcgccagcgcattatgccagttcggaacttttcaaagttttcagattgcaccagagctgctgaacaattaaagaataatccgcgacacaagagttacctagaacaagtatccctgaggcagctagagaagctattcagttttttacgaggttacttgtcggggcagagtctggcagaaacaatggaacaaattcaacgggaaacaaccattgatcctgaggaagacctgaacaaactagatgacaaggagcttgcc

SEQ ID NO: 31015 - DNA, 339 bp, Homo sapiens
  misc_feature 2, 3, 39, 45, 87, 198, 303: n = A,T,C or G
annccgaaatttcttgggtgaaaaatacatccgcagggnttcggntgagaccaggtgttgctttgttcagtatctcaagcccagaanggggggggaatccttgaaggaaatgacattgagcttgtttcaaattcagcggctttgattcagcaagccacaacagttaaaaacaaggatatcaggaaatttttggatggnatctatgtctctgaaaaaggaactgttcagcaggctgatgaataagatctaagagttacctggctacagaaagaagatgccagatgacacttaagacctacttgngatatttaaatgatgcaataaaagacctattgattt

SEQ ID NO: 31016 - DNA, 287 bp, Homo sapiens
cttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgga

SEQ ID NO: 31017 - DNA, 264 bp, Homo sapiens
atttcggatgataatctacctcactttccctgtggctatgttctgggtttccaatcaggccgagtggtttgaggacgatgtcatacagtgcaagagggagctgtggccacctgagaagcttcaagagatagaggaattcaaagagaggttacgggaagcggcgggaggagaagctccttcgcgacgcccagcagaactcctgaggcctccaagtgggagtcctagcccctcccctgatgaaatatacatatactcagttccttg

SEQ ID NO: 31018 - DNA, 305 bp, Homo sapiens
  misc_feature 25: n = A,T,C or G
aagaagtatccgtccaaataagcangaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatactcca

SEQ ID NO: 31019 - DNA, 499 bp, Homo sapiens
tcatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttgtaatttttttaatttacaaaaatataaaatatgaagacataaacccagttgccatctgcgtgacaataaaacattaatgctaacactttttac

SEQ ID NO: 31020 - DNA, 441 bp, Homo sapiens
aagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatattttgaatctttcttactgttggtaataaaccttgatggcattgggcaaacagtagacttatagtagggttggggtag

SEQ ID NO: 31021 - DNA, 256 bp, Homo sapiens
  misc_feature 24, 71, 74, 77, 92, 112, 174, 187, 233, 242: n = A,T,C or G
gctgagggggcaggcggagcttgnggaaaccgcagataagtttttttctctttgaaagatagagattaatncanctncttaaaaaatatagncaataggttactaagatatngcttagcgttaagtttttaacgtaattttaatagcttaagattttaagagaaaatatgaagncttagaagagtancatgaggaaggaaaagataaaaggtttctaaaacatgacggaggtngagatgaancttcttcatggagc

SEQ ID NO: 31022 - DNA, 475 bp, Homo sapiens
  misc_feature 31: n = A,T,C or G
gaggtcccaaaatatgtaaaaatgataatanttaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttggtattttaatctaagcattttcccccgtttctcatattttaaccatatgttcgggagataactaaacagtatga

SEQ ID NO: 31023 - DNA, 463 bp, Homo sapiens
  misc_feature 7, 8, 13, 382: n = A,T,C or G
gaagggnnagagnatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggntttggggaaatgtggagaagagtgccctgctttgcaaacatcaacctggcaaaaatgcaacaaatgaattttccacgcagt

SEQ ID NO: 31024 - DNA, 175 bp, Homo sapiens
aagaacctattaacaaaataaaggagtttattgcagtgatctttgtttttggcacatcaaaaattctcagtcattattcatgtttctttatgctgctggcttttgtgccctggaagatcataatagtgaccaaaatatacatgcagacttgttttttattattgttgtttaagca

SEQ ID NO: 31025 - DNA, 365 bp, Homo sapiens
  misc_feature 11, 34: n = A,T,C or G
tatgctcccgncatattttctctaggcttttttncttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttact

SEQ ID NO: 31026 - DNA, 314 bp, Homo sapiens
  misc_feature 22: n = A,T,C or G
agataaacagaccagtggagcnaaatacagagttcagagacagaccactgtgtatgtgggaagttagtgtacagtgaaagtgccactatgattcaatgggagaggaacagagagtgagcaaactggttcattatacagagagaaataagaccagatatcttgccaacaccacatacaaaggtgcattctatgttaattaaagacctaactgtgaatggtaaaactacaacattttaagaagatgtaggagattatttctgtacctaagaaggaaagacttcttaaacaaaacttcagaaacacaaactatcacg

SEQ ID NO: 31027 - DNA, 183 bp, Homo sapiens
  misc_feature 4, 6, 10, 17, 169: n = A,T,C or G
gggncntgcnctgaaanacatatttttgcctgtttttgtagtttagccttaagactgtacccgcagatagaggtggaaaagtaatgtgaaacgaatgtcaaattacgtttataaataaagcagctgctcattaaggttgtttttttttttaaacctccttttttattcngggttacatcattc

SEQ ID NO: 31028 - DNA, 435 bp, Homo sapiens
  misc_feature 27, 32: n = A,T,C or G
gagcaccgttcgtttttcctttagtcnggttngacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagcttttgtataagtttcgtgtggccgatcaaagaaagaaggcatacgcagatttctatagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaccg

SEQ ID NO: 31029 - DNA, 124 bp, Homo sapiens
  misc_feature 4, 34, 102: n = A,T,C or G
gacnccccacaacaaaaaagtcaaatgcctgttngggatggtgggcaatgctgatggactaaagccagtcacacgtttaccttgtcacagtctcattatgtnatcaggactgctaaactaatca

SEQ ID NO: 31030 - DNA, 441 bp, Homo sapiens
  misc_feature 33: n = A,T,C or G
aacatcctaatgcacagccacaagttacaattnaacagcctgccgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaaattgatcagggaccatgaaaagaaacttgtgcttcaccgaagaaaaatatctaaacatcgaaaaacttaaatattatggaaaaaaaacattgc

SEQ ID NO: 31031 - DNA, 356 bp, Homo sapiens
  misc_feature 355: n = A,T,C or G
tgggtcatgcatttttaacatgaatatcagaaaagcacttcgttgtattagaaggcacttctggagccaggtatggtgcctcatgccgtaatcccagctctttgggaggctgaggcaggaggatcatttgagcccaggagtttgaaaccagcctgggcaaatagtgggaccccttctctacaaagaatttaaaaatcaaccaggtgtggtggtgtatgcctgtggcccacctactgtgtgccagctactcagtagtgccagctactcgggacctggctgaggtgagaggatcacctgagacaaggaagttgaatttgcagcgagccaagatcatgccagtacacaccagcctagnc

SEQ ID NO: 31032 - DNA, 351 bp, Homo sapiens
  misc_feature 23, 153: n = A,T,C or G
gtgatgagatgaaatgatgagancagatgagatgacatgaaataatgaaatgaaattgaaatgagataagatacgagatgagatgaaatgatgagatgaaatgatgaaatgatgagataagatgaaaagagttgatgagacgatgagatgaantgagatgaaaagatgaaatgatgagatgaaatgaaatgatgagatgaaatgaggtgaaatgaaattagatgaaatgtaatgagatgaatgaaatgacataatgaaatgaaataatgaaatgagatgaaataaaataatgaaatgatgaaataatgaaatacgagatgagatgaaatgatgagatgaaatgatgaaatg

SEQ ID NO: 31033 - DNA, 474 bp, Homo sapiens
  misc_feature 24, 439: n = A,T,C or G
gctgagggggcaggcggagcttgnggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggngattaaaagaccttgaaatccatgacgcagggaga

SEQ ID NO: 31034 - DNA, 145 bp, Homo sapiens
attacgggagtgagccaccgtgcctggccttttttttggttttaagacagcaaagtagaattattcccaggctgttttgaaaatcacctaaaaacagtgatataaactctatttgaaattatgaggcatatgtaatccttgtatg

SEQ ID NO: 31035 - DNA, 265 bp, Homo sapiens
  misc_feature 24: n = A,T,C or G
gtatgaacgtttttaaaacatttnggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagtcga

SEQ ID NO: 31036 - DNA, 477 bp, Homo sapiens
  misc_feature 21, 23: n = A,T,C or G
agttataagcatcagaagcgncntgggctttgggagtattttcccttctgtctttttctccaaagggtggatccagcagagaggcttaaataatttatgaagccgagtttcacttttagaagaaaagaaaaccccatgctatttatatatatacagatacatatattactttattccccactaggcacttacacatctatcatttcattctatcctcgtgtgagaatgagaagagaaatggcctgaaccctactgtggaaaaagaaaactaaaacacagggaggtgacttggacacaatgctatgactaaatgagagccaatccagaattcaggacttctccccctcagctcagcactctttcctccaaacacgtgggtaaccccaactttgagtttccgtgcagctcccagcccagaacctgacttgctcttttaggttttatacagctttctacctggctttgtcctggatgatg

SEQ ID NO: 31037 - DNA, 408 bp, Homo sapiens
  misc_feature 7: n = A,T,C or G
ataatcnaatgggtaaaaactctgcctctgttgtcaaaaagacctgagttcaaattaaataatagctgagtgactgagtaaggtacaccccaatctcagttttcttaccagtaaaacagaaatactaaaaggaggccaggtgcagtggctcacgcctataatcccagcactttgggaggctgaggtgagtcgatcacttgaggtcaggagttcgaaaccagcctggccaacatggtgcccgtctctactaaaaatacaaaaattagccaggcatagtggcacatgcctgtaataccactactcgggaggctgaggcagcagactatcttgaatccgggcagcagatgttgtagtgagccaagatggcaccacttcatccagcctgggtgacagagcaagactccatct

SEQ ID NO: 31038 - DNA, 182 bp, Homo sapiens
  misc_feature 3, 32, 57: n = A,T,C or G
ggnaccccttaggttgacattcagaaaacttnaagacatcaccatcagcaggctccngttgaacactagtctgtgtaactttaaacatctagcagtaaatacttgcagttgtgatataaaggaccctgtttctgtagaaaagaaaacatttaacataatggttgtgaaatgtaacatgaagc

SEQ ID NO: 31039 - DNA, 437 bp, Homo sapiens
atatctatgcgtgtgcattagatccgacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgtaagttgtgtttattctaaaaagaaaatacaggaccaggaactgtggcttgacctgtggtcccaggtacttgggaagctgaggcaggaggattgcttaagcccaggagttagagaccagctcaggcaacatagagagaccctgttcccctcttgttatcccccc

SEQ ID NO: 31040 - DNA, 424 bp, Homo sapiens
  misc_feature 30, 33, 57: n = A,T,C or G
gggggccaacatcttctgaaatcaggaaanttnagtcaaatatgaatactgaaggcncacccccagccctcagtttatttcctgttagccttcccagatggtagcatccaagctctactcaccagactggagattggagaatttgggagaagattcacagaaactgacatgtggccattttgtcctaaaataggtccctccttcacctgtgctggcactcaccattcaacaagcccataccacacacagccctcagaaggcttttagtgctgctttttattaagtatgaatgagtagccagtgatcatcagacttttgaagacgtttctaacaatgaagtcagagtttgaaacaaatgagaaatgagaatcagagataaatggaaggagaaaggaacatcaaaacaaatttaatatctttggac

SEQ ID NO: 31041 - DNA, 342 bp, Homo sapiens
  misc_feature 6, 31, 192: n = A,T,C or G
attgcngtttgatcttttttttcccaacctncaaatacagcaatttcatttggtacagcctaaattaaaatatataactttttaaattaacagacattttaaaactaagaataaaaaaaagtcataagatatttatctttccatctagggatagcaaaatacttcactttaaataaattttgaaggactggngggccacaaataaaggttatattctaattacacctcctgtatttttgtttgctgtattgattagttacacatttggtacaatagatatagattgaatatgattcctattctctgcagtcatagatttgtcatttagtaattgcaagcaat

SEQ ID NO: 31042 - DNA, 386 bp, Homo sapiens
  misc_feature 92, 337: n = A,T,C or G
gagtgatgtcctttcaacctaggcactagtgacaaccttcattttttcagagctgaagaaaaaaccgtgaatttaagatcatatttattggngcatgtaagccattatcctgtcttaatgaaccgattaatgctgttgattgttgaaatgtgaaatgtagtcactgttgaccttgtaaatatctgccagagatgaaaaaatattttaagttattgtaaataaagatgtataaaattcagtatcagtctgcaatgcggaaaacatatcttagatgttaaaatactgtgtttgagagatgtgtaatttacccttagatgtatctagttacattaagagngtaaatttttttgtacagtataaaaatacagctctatttggcttttaac

SEQ ID NO: 31043 - DNA, 334 bp, Homo sapiens
taggagttaggacctttggaggcgattcagttatgagggtggagccctggtgaatgggattaatacccttatgaaagaagccctagagggctaacaggcctgaggacacagtgagaaggcaccatctgtgaactaggaaacaggccctcaccagacaccacagttgctgctaccttgatcatggactttctagcttccagtactgtaagaaacaactctctgttttttacacagtttatagtattttgttagctacgcagtttatagtgttttgttatgggaattggaactgactaagatagctatgcttaccacacaggattgttgggactat

SEQ ID NO: 31044 - DNA, 120 bp, Homo sapiens
  misc_feature 45: n = A,T,C or G
tggtgctggcaaaaagtgagctggagattggatcacagccgaagnagtaaaggtgctgcaatgatgttagctgtggccactgtggatttttcgcaagaacattaataaactaaaaacccc

SEQ ID NO: 31045 - DNA, 380 bp, Homo sapiens
  misc_feature 12, 19: n = A,T,C or G
tgctgctggagncttatgnattctcagtttgacctgattcctcttctgtcttttgacttaacattaggggttcttggtcataacctgctctgatgtacataaagatttcaggttcaatatcaatgtgtcttaaaacagaagtattttagcgggtggggggtggggtggtggggacaaacaacgcaggatataattgccaaaaccaggcttgaggttggtgactcttgaaagattttctttcttcaggcctagatcagaaaattaagtgcagcaatatcatgaattctcagaagccctttcagggagccaggtgagtcatacagtatccacagttgagtcacttaaagatgtcagtatacgaaacattattcacaatcctt

SEQ ID NO: 31046 - DNA, 326 bp, Homo sapiens
cattcacgctaaacagatgataagctcaagtctgatggtttaatagaatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttc

SEQ ID NO: 31047 - DNA, 184 bp, Homo sapiens
acatgtcaagcaatgagcctttgagtgtagcagaattgcttcataaatttaactatcactttcaaatttctgttttttttctaatttagtgcttgatagttttttatgtgataattttaaaatgctgtttgtagcaaaagttaccttgatagttcaggtgtgcagagaaaattcacagccatca

SEQ ID NO: 31048 - DNA, 111 bp, Homo sapiens
  misc_feature 7, 9, 59, 60, 63, 83, 104: n = A,T,C or G
taaaccntnacccttaggtgacactgaaaactaatggaatgtacatgtgggctacactnnggngacagggacagagcagctgnccctctcccgtcccaaaaggngagagag

SEQ ID NO: 31049 - DNA, 251 bp, Homo sapiens
  misc_feature 85: n = A,T,C or G
acttgaaatgtaaataacttatttatttctttgctaaatttggaattctagtgcacattcaaagttaagctattaaatatagggngatcatagttcctctaccaagtctggaaagaacatctcctggtatccacaattacaccaggttgctaactgtatttgtacatttccctttgcattcgcttttgttcttgctagaaacccagtgtagcccagggcagatgtcaataaatgcatactctgtatttcgg

SEQ ID NO: 31050 - DNA, 394 bp, Homo sapiens
ctcgccgttgtttattgcttaattgtactttctgctttttcctgtatttaaacatagccagctggtccctattattttgagatccaattattcccattgtttcctgttgtttttaagaagaccaattctataacgaaatcccttattgtcagtcatgtcctagagaggacagccatcattgagctttgcagcaatgctgttgtccctaataatagagtgtcttctgagttcttatgtaaaacatcatcagctggtgagttttctgatcttatgtcacatgtctactctacaatgatcattttctaacaagatatttctgctccccttttgacacagccctgacagaatccagtccctagatactctgctggcttttcctagtatatgctgacta

SEQ ID NO: 31051 - DNA, 162 bp, Homo sapiens
  misc_feature 3, 23, 159, 162: n = A,T,C or G
gtngacttgtatgtatgtgatgncgtgtttaattctaggagtacagctgatgaagaacttgcttgacaagtttttaacttatgtattatttcgaagcagtgtttaccgtagcagtaacatgaaggtttctaataaaatacccaatgtacacaagcgccntan

SEQ ID NO: 31052 - DNA, 267 bp, Homo sapiens
  misc_feature 33, 171, 219: n = A,T,C or G
agcctccgaatatgaacacacttttctatattnaccttatagcaattttattttagtttttgcattttttttttcaggcagggtcttgctctgttgcccaggctgaagtgtgttggcgtggtctcggctcactgccacctccgcctcctgctcgggaggctgaggcagganaattgcttgaacccaggaggcggaggttgcatttgagccgggattacnctactgtactccagcctggttgacagagcaagactctgtcttgtacct

SEQ ID NO: 31053 - DNA, 306 bp, Homo sapiens
  misc_feature 29, 31: n = A,T,C or G
cacttcagtgtctggcccgcaatactgtntnaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 31054 - DNA, 467 bp, Homo sapiens
  misc_feature 5, 24, 29: n = A,T,C or G
agagncgatgcagctagcctgaangactntttaatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaaccta

SEQ ID NO: 31055 - DNA, 126 bp, Homo sapiens
taaaagaacacagactggcaacttggataaagagtcaagacccatcagtgtgctgtattcaggaaacccatctcacgtgcaaagacacacataggctcaaaataaagggatggaggaagacctacc

SEQ ID NO: 31056 - DNA, 355 bp, Homo sapiens
  misc_feature 280: n = A,T,C or G
agaccctgagactgacctgcaggacgaaaccatggagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgcnatggtttatggatacaatgctgcctataatcgctacttcaggaagcgccgagggaccaaatgagactgagggaag

SEQ ID NO: 31057 - DNA, 103 bp, Homo sapiens
aggctgagaaggagaatggcgtgaacgtcggaggtggagcttacagtgagccaagatcgcactattgcactccagcctaggcgacagtgcaagactccgtccc

SEQ ID NO: 31058 - DNA, 437 bp, Homo sapiens
  misc_feature 233, 350, 389, 436: n = A,T,C or G
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggtngagatgaagcttcttcatggagtaaaaaatgtatttaaaagaaaattgagagaaaggactacagagccccgaattaataccaatagaagggcaatgcttttagattaaaatgaaggngacttaaacagcttaaagtttagtttaaaagttgtaggngattaaaataatttgaaggcgatcttttaaaaagagattaaaccgang

SEQ ID NO: 31059 - DNA, 355 bp, Homo sapiens
  misc_feature 123: n = A,T,C or G
tcccatttacctgttgttgctgctgtctgttttcgtgattcagcaagtttcatctcaagagctttcctgtaaaggccgctgctttgagtccttcgagagagggagggagtgtgacttgcgacncccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaaga

SEQ ID NO: 31060 - DNA, 123 bp, Homo sapiens
gtgtcaggcccctaaaccttgacccttaggtgacactgaaaactaatggaatgtacatgtgggctacactttgttgacagggacagagcagctgtccctctcccgtcccaaaaggagagagag

SEQ ID NO: 31061 - DNA, 345 bp, Homo sapiens
  misc_feature 34, 42, 58, 161, 162, 231, 297, 306, 327, 340: n = A,T,C or G
aactcccattatgggaaatgcaaaagttgttttngatatggnagtgtgtggttctctnttggaatttttttcaggtgatttaataataatttaaaactactatagaaactgcagagcacaggaagtggcttaatgatcctgaagggatttcttctgatggnngcttttgtattatcaagtaagattctattttcagttgtgtgtaagcaagttttttttttagggtagganaaatacttttccattgtttaactgcaaaacaagatgttaaggtatgcttcaaaaattttgtaaatngtttatttnaaacttatctgtttggaaatnggaactgattaanaattg

SEQ ID NO: 31062 - DNA, 272 bp, Homo sapiens
tgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgtttttaatattatagttgggggagattcattaaaattaaattgaaataaaattatttttgcat

SEQ ID NO: 31063 - DNA, 146 bp, Homo sapiens
atatcttcaggcttgactaagtaaaatatgtatttatctccttataaacaaagagaacatttttattaccagtgtataaaaagagatttgatactaattttgtaaattaatgtgggtgaggtgttgaaaggaaaaagaaatagtag

SEQ ID NO: 31064 - DNA, 375 bp, Homo sapiens
  misc_feature 289: n = A,T,C or G
ccaggctggagtgcagtggtgcgatctcggctcactgcaaacttctccgcctcccaggttcaagcaattctctgcctcagcctcctgagtagctgggattacaggcgtcgccaccacgcccagctaatttattgtatttttagtagagatggtgttttaccatctcggccaggctggtcttgaactcctggcctcaagtgattcgtccacgtcggcctctcaaagtgctggaattacaggcatccaccgcgcccgcccagttttgttgtatttgattagtaagtttggncactgcacatacaaaagctaaaaaaggctgtgtgtagaaatcattcaaatattgagatatttaaatgaaaggttaacgctttggga

SEQ ID NO: 31065 - DNA, 380 bp, Homo sapiens
  misc_feature 178, 179, 280: n = A,T,C or G
agaccctgagactgacctgcaggccgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagnnggagagctaaagtccaagagaggatccgagaacgctctaagcctgtccacgagctcaatagggaagcctgtgatgactacagactttgcgaacgctacgcnatggtttatggatacaatgctgcctataatcgctacttcaggaagcgccgagggaccagatgagactgagggaagaaaaaaaatctctttttttctggag

SEQ ID NO: 31066 - DNA, 486 bp, Homo sapiens
aaaacactgaagaaactttagtccctagacagtagtttgaggagacctttgactctaataatagccatggtaggatagaggacaaggtagatgtcaaaaaccaacagggcttggtaacagagggattttaattagatttgtttatttaagatggtaattgaagaaattgagtcaatgacagaaatagagtaatgccaaacacaaggatttgaataacagctaatatattaagaatgtctatgtccttatttattttcaagtgaaaacaggaaatccaggtaaaattttcccatggccagttggaagcattcaaggttgaattagaaatcagggtttgagctaggtgcagtggcttacacctgtaatctcagcattttgggaggctgaggcagatggatcatctgaggtcaggagttcgagaccagcctgaccaacaaggtaaaacccggtctctactaaaaatacaaaaattagccaggcgtggtg

SEQ ID NO: 31067 - DNA, 210 bp, Homo sapiens
  misc_feature 178, 179: n = A,T,C or G
agaacagcagactcagctctgaccttctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtatatatatatatgtgggnnggtatctaagttaatttaaaggtgtgtgcgc

SEQ ID NO: 31068 - DNA, 439 bp, Homo sapiens
gtgccactcactgccttgagcctgcttcctcactccaggactgccagaggaagcaatcaccaaaatgaagactgctttaattttgctcagcattttgggaatggcctgtactttctcaatgaaaaatttgcatcgaagagtcaaaatagaggattctggagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtataca

SEQ ID NO: 31069 - DNA, 106 bp, Homo sapiens
  misc_feature 21: n = A,T,C or G
aaacctgacctcctttatggntaactactattaagcaagaatgcagtacagaattggatacagtacggatttgtccaaataaattcaataaaaaccttaaagctgg

SEQ ID NO: 31070 - DNA, 419 bp, Homo sapiens
  misc_feature 24: n = A,T,C or G
gcgtggtatacccccacataaacntatattgagttttaagaaaaattagtttcatttactattttgaggatatataagctttggttagaaattttgttttatttcccgtttttgtattttaattaaagattagaggctgggccgcagtggctcacgtctgtaatcccagcacttttggaggccaaggtgggcggatcatttgaggtcaggagttcgagaccagcctgaccaacatggtgaaactccgtccctacgaaaaatacaaaaaaattagctgggtgtggtgggtgcatgtatgcagtcccagctacttgggaggctgaggcaggagaatagcttgaacccaggaggcggggttacagtgagccaagattgcaccactacactccagcctgggtagcagagcaagactgtgtctc

SEQ ID NO: 31071 - DNA, 100 bp, Homo sapiens
ggccaggtactatgattatgattttcccctatcaatttatgggcaatcatcaccaaactgtgcaccagaatgtaacttgccctgaaagctacccaagtgc

SEQ ID NO: 31072 - DNA, 123 bp, Homo sapiens
tggctcgatattataagaccaagcgagtcctccctcccaattggaaatatgaatcatctacagcctctgccctggtcgcataaatttgtctgtgtactcaagcaataaaatgattgtttaact

SEQ ID NO: 31073 - DNA, 305 bp, Homo sapiens
  misc_feature 10, 14, 28, 29, 31, 33, 40, 130, 136, 139, 285: n = A,T,C or G
atgatcgtgnaccntatcctgcatcccnncngncattgtnggagcaaaaaagcacctattataccaggactttaaaaatcagtctgataagtctttgataagtctaataataataactgataagtccatngaattngcngctgattactttttctttagtagctaaacatgtatgtactcctatgattacaatgaacactcctctccatttaaattaattatttacattgatgaaatagcaaaatgttaatgactaaatactgtcttggttttttcgttccaggncagtcaatattaacttctta

SEQ ID NO: 31074 - DNA, 345 bp, Homo sapiens
  misc_feature 21, 93, 180: n = A,T,C or G
gccaaagcaatccaaagcaanccgagcaaagctggaggcatcacattacccgacttcaaactatacaagactacagtaaccaaacagcatggnaagggtacaaaaacagatacatagaccaatggaacaaagtagagaactcagaaataaagccacacagtctacaatgacaacaatggngaaagaactcccttttcaataaatgcttctgggataactggctagccatattcagaagattgaaactggatcccttcctgtcactatatacaaaaattaactcaagatggattaaagacttaaatgtaagacctaaaacagtacaaaccctagaagaaacataac

SEQ ID NO: 31075 - DNA, 422 bp, Homo sapiens
  misc_feature 164, 186: n = A,T,C or G
acacgcttcttctggaagaccagccaacaggtaagcggcccaattcattgttggagggtgaaagctgattagagaagagaattgaatacacaaaacacgtgttgttgcttccttttttctgttttaatttgcagacattctcctccccccccaaaaaaaagggngatttgtacaattttttatggngctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatttatttgggatgaaattgg

SEQ ID NO: 31076 - DNA, 418 bp, Homo sapiens
aaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgtttttgtaaacatttattttttttaaag

SEQ ID NO: 31077 - DNA, 106 bp, Homo sapiens
  misc_feature 25: n = A,T,C or G
catgattgctctctgtccctttttncagcttatgggtatttatcttctattagtatttgtatcttcagttcattccactttaggaaacagagctgccaattgaaac

SEQ ID NO: 31078 - DNA, 414 bp, Homo sapiens
  misc_feature 125, 178, 235, 380: n = A,T,C or G
tgaggaaagccgtgcgttgcgttccaaggcatctgtgagcccgcggagtatacaccatgagcaaagctcaccctcccgagttgaaaaaatttatggacaagaagttatcattgaaattaaatggnggcagacatgtccaaggaatattgcggggatttgatccctttatgaaccttgngatagatgaatgtgtggagatggcgactagtggacaacagaacaatattggaatggnggtaatacgaggaaatagtatcatcatgttagaagccttggaccgagtataaataatggctgttcagcagagaaacccatgtcctctctccatagggcctgttttactatgatgtaaaaaattaggtcatgtacatttttcattnttagactttttgttaaataaacttttgtaatagc

SEQ ID NO: 31079 - DNA, 376 bp, Homo sapiens
  misc_feature 153: n = A,T,C or G
aaaaatcttacaggagctgaaaatgagttgaagattagttattatttcaggccttttaaaaggcgagagaaaacagaaaagagcaagatgcaataaaagtcgaactttgtgtaaaaaattataatgccttgtaatttattaagagtaaagcantaccttaagaaaattttgtagttcaaaccaattctttagtgtataagtggttttttaaaaatcaaaacccaatctctggaaagaccattttaaataatttccctttaattgtagacaacttgctcatatgaaagctttttttcatctgtcttcttcttatgatgtaaacagaccatttctgacatgcttggactttctagttttcctgagcatccctctttcc

SEQ ID NO: 31080 - DNA, 256 bp, Homo sapiens
  misc_feature 25, 71, 74, 77, 92, 112, 186, 187, 233, 236: n = A,T,C or G
gctgagggggcaggcggagcttgangaaaccgcagataagtttttttctctttgaaagatagagattaatncanctncttaaaaaatatagncaataggttactaagatatngcttagcgttaagtttttaacgtaattttaatagcttaagattttaagagaaaatatgaagacttagaagagtnncatgaggaaggaaaagataaaaggtttctaaaacatgacggaggtnganatgaagcttcttcatggatt

SEQ ID NO: 31081 - DNA, 464 bp, Homo sapiens
  misc_feature 25, 174, 460: n = A,T,C or G
agaaattacacctgaaaatggcacngacctcagtctaggtctgtgatgcactgttgtgttaacaagaactttttgttactttatgcacattttctgtactatctgagagatgccagtatcttatccacacacgagaactttattctaaatatttgtaaattttccacctgcagncaggcaattattataaataagatgaaaaacacttgtactgtttcctgtaaccaatacattgtttaattaaggaggattgctaagcctgaaaacataaagatagttggtagtgggttttgaagtcatagaggacattttctaaaatgcttaaatctcacacttctgggtaccaatttgattcagactcctctaaagagaaatagcactctgggggaataatcagccccaagaactatacctattagaaaatctctcaccttatataagggagagaaccagaaggggngaga

SEQ ID NO: 31082 - DNA, 389 bp, Homo sapiens
  misc_feature 3, 25: n = A,T,C or G
agnataaaaactttcctgataatanccacatttgatgtgcatttaccagttctttctttactgtggtgccccttttgctagaccaaaagctcccaacgaggaactctgttttgttttctgctgcctgctctgtacccagccaagagcctgatacacagccttactcagtcagtacttgaaggaaagcaggcaggcaggattaaccagatttctatggtgtctcaaatgatccatttctgcacctgttttccagatactcagtaggagaaaaatttaaggattgagttgcttgattatgggtgtattttaatgtgtttcctaacatgctgaggagaaaagtgggtctgtttcaggatttatgctccagctagagggattttttaaaattg

SEQ ID NO: 31083 - DNA, 335 bp, Homo sapiens
  misc_feature 24, 25, 322, 332, 334: n = A,T,C or G
gagaggcaggtttgcgtgacccanntcccagcttgaattttccctttagctaaatgagtttggggtccccaaatttaatttcctttcacaatacctaggctatacagtatagcctattgctctcaggctgccaacctgtacagcatgttacttgtactgaatactgcaggcaatttggaacactatggtaagtatttatgtatccaaacacatctaaacacagaaaaggcacagttaaaatacgttttataatcttaaggaaccgctggtgtatatgcgatccatcattgaccaagacatccttatacaacgcatgactggntttttaaaanang

SEQ ID NO: 31084 - DNA, 388 bp, Homo sapiens
aattcacctaaaattgttcattgtggttgtatcttaaaatctttggggtcgttgaatgaactttggcttagaaatttgtagagatcgtctttttaactgctgtgagtctgcagatgtgattatctatagtaattccagatgttttctcatctattagttttactgagtaggaagataactgagaacaacataaggtaacttcaaagcagtttgctagcatttaatcctgactaatttaattaattattcatccttgtagtttttcctatttttttgattatgaaactgagacaaaggttacgagttgcccaagatgcttggggagtattaaagatagcccaaagcttaaactctaacactgttcagacttttagcttgctttttctta

SEQ ID NO: 31085 - DNA, 316 bp, Homo sapiens
caaagtgctgggattacaggcctgcgccaccacgcccggctaatttttttgtatttttggtagagatgaggtttcactgtgttagccacagatcccgacctcatggtctgtctgcctcagcctcccaaagtgctgggattgcaggcttgaatcaccgcacccggccggaagtctccatactttttaacccaatctaaaatggtaaggaaatatataagaatgtctatttattattaaattttttctatataaaacatttcagaaaataaagactagcatttctgagccaagtggtagtagtggccattctttctgc

SEQ ID NO: 31086 - DNA, 124 bp, Homo sapiens
  misc_feature 9: n = A,T,C or G
cttgcatcntggtgaaggaagaagtggggtggaagaagtggggtgggacgacagtgaaatctagagtaaaaccaagctggcccaaggtgtcctgcaggctgtaatgcaagtttaatcaggagtg

SEQ ID NO: 31087 - DNA, 389 bp, Homo sapiens
  misc_feature 180, 335, 381: n = A,T,C or G
catacatgcctgcacgtcagctcgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggngtttttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggngcataaaacccttaaattcatctagtagctgttcccccgaacaggnttatttta

SEQ ID NO: 31088 - DNA, 147 bp, Homo sapiens
  misc_feature 2, 24: n = A,T,C or G
tngtcccaggccaaagactaacanctgccttgggaatcccttccttgtgtccttaccaaatgatagctcataaaactctgatgatgtaacaaatcactttcaaaggagttcccagaagtcttcagaaagactaaaattctgtctctt

SEQ ID NO: 31089 - DNA, 178 bp, Homo sapiens
tggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgagcgtc

SEQ ID NO: 31090 - DNA, 339 bp, Homo sapiens
  misc_feature 60, 177, 338: n = A,T,C or G
gagtcgggcccctccatcgtccaccgcaaatgcttctaaacggactcagcagatgcgtancatttgctgcatgggttaattgagaatagaaatttgcccctggcaaatgcacacacctcatgctagcctcacgaaactggaataagccttcgaaaagaaattgtccttgaagcttgnatctgatgtcagcactggattgtagaacttgttgctgattttgaccttgtattgaagttaactgttccccttggtattaacgtgtcaagggctgagtgttctgggatttctctagaggctggcaagaaccagttgttttgtcttgcgggtctgtcagggtng

SEQ ID NO: 31091 - DNA, 111 bp, Homo sapiens
  misc_feature 106: n = A,T,C or G
atgccactgaattgtttacttgataggtgcagcaaaccaccatggcacatgtatacttatgtaacaaacctgcacattctgcacatgtatcctggaacttaaagtnaaata

SEQ ID NO: 31092 - DNA, 382 bp, Homo sapiens
gcgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaagggctggaatgtgttgagcctaactgcagatccaagaggatgctggccattaagagatgcaagcattttgaactggggaggagataagaagag

SEQ ID NO: 31093 - DNA, 214 bp, Homo sapiens
  misc_feature 177, 212: n = A,T,C or G
atgtatgtattcatagtcatacctttaagaaagcttctgagggctgtgtgttaggacagggcaggagtctttgttttgggcaattcgggaaaatatatttgaaaatatatttttactttttctcctttgatccagcaaggatgttttcctgctaatttaatgggtcatagaatgagntatatttgaagtaaattgcctgatcaagtatgaantc

SEQ ID NO: 31094 - DNA, 298 bp, Homo sapiens
  misc_feature 151: n = A,T,C or G
caaagacaaaccaagtggagacacagcagctgtatttgaagaaggtggtgatgtggacgatttattgggcatgatataggtcgtggatgtatggggaatctaagagagctgccatcgctgtgatgctgggagttctaacaaaacaagttgnatgcggccattcaaggggagccaaaatctcaagaaattcccagcaggttacctggaggcggatcatctaattctctgtggaatgaatacacacatatatattacaagggataatttagaccccatacaagtttataaagagtcattg

SEQ ID NO: 31095 - DNA, 180 bp, Homo sapiens
  misc_feature 21, 22: n = A,T,C or G
tggcatcagaggaggcctggnnaaatttcatgacttttattatctcgcagtggtaataaggccacctccactgcaatgtcagtggagactaaaacagaaaggaattttcctgttgtcttcattataagaacctggtgagttcctggagatatgactcatgaatgtgtgcccccacccgtc

SEQ ID NO: 31096 - DNA, 305 bp, Homo sapiens
  misc_feature 20, 29, 30, 41, 47, 50, 59, 62, 66, 286, 303: n = A,T,C or G
gaggcgagcaagcaagatgnatgcgccannccccagcgagntgacantangcctggggnccngcanagggagctctgtctcctcccatcgggaggaacagagagccaggaccaaagctccttatgtaagcaacccccagcctggagcataagagatcaagatccaatgctaaactccaatgggggagggaccggggttgctcttcttcaagccagctgatacctgtgcatactgcaggcatctaaattagaagacctgcgagtaaaactgaagaaagaaggatatnctaatatttcttatatngg

SEQ ID NO: 31097 - DNA, 350 bp, Homo sapiens
ggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagaga

SEQ ID NO: 31098 - DNA, 447 bp, Homo sapiens
gttttgttaaaattgaaaaataggctgggcatggtggttcacgcctataatcccaacacttcgggaggctgaggcgggcagatcacatgagtctaatttatatatatatatgtatgtatgtatgtatgaaaaattagggaggggcagaatttctttaggggcagtagcagggaggatcccgaactcagtcatagaatttttaggattgaaacaaagtttgaggtcagaggggaacataaaaccttggtaataccccgcccccggccaccatctttgtacatgtgtctttgcagcttagtgcatctctttgacaaagatttgtgcaatgatgtattttattcaacacatcattctgaaagaacgtgtggaaaactaatgactgagcacaaacctgttgaagatgcagttcttcttggtagcctaaataggattatcttggacctaaga

SEQ ID NO: 31099 - DNA, 265 bp, Homo sapiens
  misc_feature 9, 10, 23, 32: n = A,T,C or G
ggagcgagnntatatactggagnacgcacagnatccccccaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccg

SEQ ID NO: 31100 - DNA, 432 bp, Homo sapiens
atttctggaggggaaaaagatccattctacgtatccttgtggagaaaagctaaataacctttaagaatgtgggtggtattggagaaagaagatgaattatagctccggagaatcaagatcttaagtgaagcctttctgttcagatgtgatctataaaaaatcataatttggggaaagtttaagcaaatctggctttgtagtcctgatgttataagtgactttgtgatcaaactgtcaggcttgggttctcgttatagaatgcttggtatagaaaaaccatgccatcattaatggctaacaacacgtagggacttcatgtcatgtcaaagatagctctttgcaagtgccttgattaaaccagaaaactgtcatcgtttaacccaaatatctgaatggtcatctggtaactcatgggtttttggcctcataaga

SEQ ID NO: 31101 - DNA, 370 bp, Homo sapiens
catgaaccaactcctgctagcttccaacttttcttctgcggattcatcacctctctcagccgtaacagaattgaaaagagttgcgctcttgctctgaattaggctttggcttagggaatgttctagctggtttgctcttctatccagaccactcagactttctccacattagcagtaaggctgtttcactttcttatcattgatgtgttcactggagtagcatttttaatttccttcaagaacttttcctttggctgggtgtggtgtctcaggcctgtattctcagcgctttgggaggctgaggcgggaggattccttgagcccaggagttcgagaccagactgggcaacgtggtgagaccctgttgcat

SEQ ID NO: 31102 - DNA, 217 bp, Homo sapiens
aaaatgtctatcccatgaccgttcccaataaacatttttgaaatgcaggttgagtatccctaatccaaaaatccaaaattcaaaatgcttcaagatctcaaactttttgagtgccgacatgatgttcaaaggaaatgctcattggagcattttggttttcagatttttggattaggatgctgaactggtaagaataatgcaaatattccaaaatcct

SEQ ID NO: 31103 - DNA, 159 bp, Homo sapiens
  misc_feature 2, 3, 17, 30, 31, 39, 157, 158: n = A,T,C or G
cnnttatggcccgggcntttaaaaagtaanncaaaaaanactcaacgattctttcagctttattaacattttccattgtttcttgcgacttgtgtctcgttctttgtagtattgatgatgaacatttgataatgaatgttcttgtatattcagattnng

SEQ ID NO: 31104 - DNA, 473 bp, Homo sapiens
  misc_feature 21: n = A,T,C or G
gaagtgtgaaatcttcagaanaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaact

SEQ ID NO: 31105 - DNA, 434 bp, Homo sapiens
gggactcctttggctatggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggagttgggtgagaacctgactgatga

SEQ ID NO: 31106 - DNA, 377 bp, Homo sapiens
  misc_feature 41, 375: n = A,T,C or G
tatggccggggattctagcaatagtgattccactcagagtnagaagtctggcaggaactcgaacccccggcaagtaggcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaaatatattgtgagttttctatttcactaatcatgagaaaaactgttcttttgcaataataataaattaaacatgctgttncc

SEQ ID NO: 31107 - DNA, 130 bp, Homo sapiens
  misc_feature 42: n = A,T,C or G
atgggaatatgattcaagatgagatttgggtggggacacagnagtcaaaccatatcagatgttatgaataaacctgcaaaacacagagaccctcttactaaggtagaagcttaaaaaacatgactaattt

SEQ ID NO: 31108 - DNA, 226 bp, Homo sapiens
  misc_feature 1, 15, 225, 226: n = A,T,C or G
nattatggccgggancttggtgcgctatggcgacacccagcctgcggggtcgtctggcgcggtttgggaacccgcggaagcctgtgctgaagcccaataaacctctcattctagctaaccgcgtcggggagcggcgccgggagaagggcgaggcgacttgcatcacggagatgtcggtgatgatggcttgctggaagcagaatgaattccgcgacgatgcgtgcnn

SEQ ID NO: 31109 - DNA, 496 bp, Homo sapiens
  misc_feature 6, 12: n = A,T,C or G
cacctntggctnttatggaccgggggcctcttaggtgacgctgggaagtgcctgcagccttcgccgctgccttctggttgaagcactatggagggagagaggaagaacaacaacaaacggtggtatttcactcgagaacagctggaaaatagcccatcccgtcgttttggcgtggacccagataaagaactttcttatcgccagcaggcggccaatctgcttcaggacatggggcagcgtcttaacgtctcacaattgactatcaacactgctatagtatacatgcatcgattctacatgattcagtccttcacacagttccctggaaattctgtggctccagcagccttgtttctagcagctaaagtggaggagcagcccaaaaaattggaacatgtcatcagggtagcacatacttgtctccatcctcaggaatcccttcctgatactagaagtgaggcttatttgcaacaagttcaagatctggtcattttag

SEQ ID NO: 31110 - DNA, 341 bp, Homo sapiens
tgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgacttt

SEQ ID NO: 31111 - DNA, 374 bp, Homo sapiens
  misc_feature 8, 13, 32, 44, 49: n = A,T,C or G
ctcggccntttantggcccgggggcctttgancttgccaatacnaaatnattacgaattttatagttatcagaacattacgtttctttataaagacccctaaggtcactcttctttttgcaacttaagggaaaaaatattctcaagggaaaatactttttgaaatttatcaccattttagtgtttacatttcaataaatagttcacttcaggtttgggattgagattagttgcaatatatttagaagctcctacatgacagcacagatcactgccatctgctgaactgctaaagtgcttggtgccatgttgagaaaacttacccaagaatggataaatttgggtgaaacattactgagaatgcctcacgttagc

SEQ ID NO: 31112 - DNA, 314 bp, Homo sapiens
gacacgccttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatt

SEQ ID NO: 31113 - DNA, 471 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttata

SEQ ID NO: 31114 - DNA, 406 bp, Homo sapiens
attctaatacaattcctaacagaagttggtacaacactggctaattcagaaatcgctcctcagacttagattccaagagtatcaaagagattagatgggaggctgggccaggaacccttgttttaatgtatttgtccataattaacactggtgaccatataaggaacaaagtatatctgcacatttcactgagacatctacattggaaaacccaaacaaaaagaagcaattcaaataaaaagacaacataagaacgaaaataagttggtcacattaacactggaagccatctttaagtgagtgctgtcatattgtgtcacggtaatttttagccaaatatggcatttgtaaatttaaactttctctcatggaaagggggctggtacctgtcaaagtgttattttat

SEQ ID NO: 31115 - DNA, 417 bp, Homo sapiens
cggccggaaccgccatcttccgtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaact

SEQ ID NO: 31116 - DNA, 370 bp, Homo sapiens
atggccggggatttgggaatatagtgtccttgtaagtatggtgttgcttttgttactttattctctactttattaaaaacagtgcttttaaaaaattggtcagtggaacttcagggttcaggcatcttttagtcagaatcacaatgccattcttgtccaaggaaatgaaagttctcagccaggtgtactctgggaggccaagaggggtggatagcttgagcctaggcgttctagaccagcctgggcaacattgcaaaaccctgtctctacaaaaaatacaaaaattagctgggagtggtggtgtgtgcctgtagtcccagctactgaggaagctgatatgggagaatcgcttgagcccatgaggttgaga

SEQ ID NO: 31117 - DNA, 136 bp, Homo sapiens
  misc_feature 112, 115: n = A,T,C or G
cttattgtgtaaattttaagttcctcatttctttatgaacaaacattaaattgtctgcttacatgaagcaggtattgtaaggcttaaatgcattagacattttcagaggcgngtntaaagagcacaaaacagaatt

SEQ ID NO: 31118 - DNA, 407 bp, Homo sapiens
tatggccgggggggctgaaggctggggctgaagtcctctcagggcgcacgtgtttgttcacatgtccagcgttggtgctggctgtcatctgacctcagttcctctccatgtgggctgctcccacatctgcttcggctagattgagcttcctcacaacatggtgactggattccaagggcgagtatagagagtgagagtcaggtggcagctgtatcatttcgatgacctagtctcaaaagtcacatggcatcacttcctgcacattctactggtcaaatagtcacaaggtccctagattcaaggggaattgacctgtgccccatctgtcagtgagaggaatgtccatcatactgtaaaaagagtatgtgaatagtagcaaaatattgatgcagccatccctggagaga

SEQ ID NO: 31119 - DNA, 130 bp, Homo sapiens
ggacttcggcagtctgtccaaccttcaggtcactcagcctacagttgggatgaatttcaaaacgcctcggggacctgtttgaattttttctgtagtgctgtattattttcaataaatctgggacaacagt

SEQ ID NO: 31120 - DNA, 399 bp, Homo sapiens
gtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttttaagaaaaccact

SEQ ID NO: 31121 - DNA, 200 bp, Homo sapiens
agtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 31122 - DNA, 322 bp, Homo sapiens
ggaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattacagaattgtttagattttgtgtttattcttgatgaaaagctttgtttg

SEQ ID NO: 31123 - DNA, 417 bp, Homo sapiens
ggggcattcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaaga

SEQ ID NO: 31124 - DNA, 279 bp, Homo sapiens
atggccgggatttaaaaaagaatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctctttt

SEQ ID NO: 31125 - DNA, 395 bp, Homo sapiens
agcgaataactactgagcaactctagtgtgccagcacaggccagacatactagtgagccaggcacatctggccttgggaaactcatcctacaggggaaggccagttttttttcccttcaattcctcaagtctgggtggtgacaaggtaggggctaggtactggactaccacaggtttttaggaactaaggtgtttctcataaacacaaaatgttgggtgaaactgggaacaactactcagaagctaatttatttgcttaaatggaaagtgtgggagccactaccctcccttttgatctgccaaggatttcctctcagagctgttgcacagacagagattgtacttggtaagataccaaacaagacagatatggatctaaatttctaatgtgttct

SEQ ID NO: 31126 - DNA, 360 bp, Homo sapiens
  misc_feature 349, 355: n = A,T,C or G
aaggacggcaaccatgagtagtgtctttcctctttcctttccaaaaatgtctcttccactgtcttttctagtgccatgtctcatgttttggtaaaactaattgaaccttgtatctgtactgctgttcatgtttgacctcctcccttaagtgttaagcaagtcctccctgaccacgcttgtcccaccctccctccacaaaaccacataggtccacattccatctccctgaagagtcactgcccaactcttcaaggctttgtttagctaccttcttttctgagatacattttctgatcagatcgaaccagttaaaccagatttaaactctttttttttttgaaacggagtntcgctntgtca

SEQ ID NO: 31127 - DNA, 440 bp, Homo sapiens
gggtaaaataattatttgtggtttaaaatacacatagaatttaaaaatatagtagtagcatataagttgtgggggtgttaaataaaagttaatatcttacggtcttttcattgcccaggaagtggtaaaaatattaatttacttgagactttgataagtcaaggacacatgttgtaatctctaagatagtcattaaaagagtagtaaaagatatgtaattaacaaattaatagaggggaaatatggaatagtaacagcagtagtagtagtaaaacttgattaatctgaaagaaggcaagacgaccaaaaacagaaacagagcatgtgggaaaaataggaagtgaacagtaagttgttagatttaaacttagtctatcagtaattatattaaataaaaatgaaccaaaatttctaattaaaaagcaaagattgggaaattg

SEQ ID NO: 31128 - DNA, 361 bp, Homo sapiens
  misc_feature 15, 30: n = A,T,C or G
ggaactgagtaccgnataaagaacccaagnagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatg

SEQ ID NO: 31129 - DNA, 425 bp, Homo sapiens
cactgattcaacaactgtggaacaaaattgtcagaaaaaacaatacaacaataaaaaatgatacaaataaaaaacagcatggtataccaactatttatgtagcatttacatcatattaagtattagaagtaatctagagatgatttaaagtatataggaggatgtgtgtaggttatatgccaatactacactattttataccagtaacttgagcatccatggattttggtatacaagggggatcctggaaccaattccccatgcatatcaaaggatgactgtatgagttatctgtaaaaaaatgttttggttgaaatgtttagaaaacagctagacaagactggctgttggatgacaaaaacataggactaggaaattcaggtatgctactctttttgagtattgtttaaagccataggaaaaga

SEQ ID NO: 31130 - DNA, 471 bp, Homo sapiens
  misc_feature 30: n = A,T,C or G
ggagcatttaagaagcatcctctgccaagnaccaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcattagattct

SEQ ID NO: 31131 - DNA, 369 bp, Homo sapiens
gaagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggccgttggactctgtgagatggagagccaatctcacattcaagtgttcaccaaccactgatgtgtttttatttccttctatatgattttaaga

SEQ ID NO: 31132 - DNA, 224 bp, Homo sapiens
  misc_feature 24: n = A,T,C or G
tgatttatttttttaatgattttnagttctcagtttagaagcacgattggctgatagtttctatgactcaagatgaaatgtattcactgcttaattgaatgcaacagttgtgttttgtttacaaaatcttatctaaaatgaatgctttctgccacacatcaagtcagctactgtaggcaactcttttagtccagctagcaaatgggcagaatgcccacacgacc

SEQ ID NO: 31133 - DNA, 442 bp, Homo sapiens
  misc_feature 1: n = A,T,C or G
nattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcataaagcagaacagcctcccgaatgaagcgttgccattgaactcaccagtgagttagcagcacgtgttcccgacataacattgtactgtaatggagtgagcgtagcagctcagctttttggatcagtctttgtgatttcatagcgagttttctgaccagcttttgcggagattttgaacagaactgctatttcctctaatgaaga

SEQ ID NO: 31134 - DNA, 348 bp, Homo sapiens
gaattcagctacttctactcttctaaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtgg

SEQ ID NO: 31135 - DNA, 196 bp, Homo sapiens
  misc_feature 1, 17, 26: n = A,T,C or G
ntttttctcccccgggnaattcggcncttatggcccgggataacgggtttgaatgtaattagttatttaaattacatacaattaactggaaaagggaaattattgatctaagttggggtttttttgttgttaaaaaggaaagggaaaggagaagatataatctgtttctgcttgcttcttagtctttacaagtgtt

SEQ ID NO: 31136 - DNA, 197 bp, Homo sapiens
  misc_feature 1, 9: n = A,T,C or G
nattaaagnaaaatcttttgaaatggctgttttttaaggaagagaatttatgtggcttctcatttttaaatcccctcagaggtgtgactagtctctttatcagcacacacttaaaacatttttaatattgtctattaaaaataggacaaacttggagagtatggacaactttgatattgcttggcacagatggtatt

SEQ ID NO: 31137 - DNA, 426 bp, Homo sapiens
  misc_feature 69, 192, 199, 233, 277, 290, 399, 425: n = A,T,C or G
gatcttttctttttctttcttttttttttgagacggggtcttgctctgtcacccaggccggagtgcagnggcatgaacatagctcactgcagtctcggtctcctgggcttcagcgatcctctcttgcttcagcctcccgagtagctgggattacaggcatgtgccaccacacctggctaattttgtattttnagtaaanacggggtttctccatgttggtcgggctggtctcnacctcccgacatcacgtgatctgcccgcctcggcatccgaaagngctgggattacanatgtgacctatcgtgcccagccgctaaacctcatctttaaaaaagaagaacaaaatagaacatggacaagatggctggggtcctgtggagttctagtaatcttcttacnataataaagcaaccttatgccatatna

SEQ ID NO: 31138 - DNA, 361 bp, Homo sapiens
  misc_feature 3, 19: n = A,T,C or G
atnagaagtgattttagtncagttctgcgggagagcttagaataacatcctcctttgggaggtggtctcgggtgcgtggatgttggtatacagtctttattgtaagtctgatacaaaatgctaataaatttaatgtttttcttccttaatttattggcatagttcttcaggtagcacctcatttttattaatgatattgggattaactatgaacaagctatatgtagacatttgcatttaaggacattacagtgtttcaaagatcccatcattgcagcttgtatcctttagatccaatcggaaacttctggagtcttacattaatgctcatttgagctaattagtaatctgtttaaacaga

SEQ ID NO: 31139 - DNA, 398 bp, Homo sapiens
ggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccaga

SEQ ID NO: 31140 - DNA, 136 bp, Homo sapiens
ggctcgtgcgtcgatgaagaacgcagctagctgcgagaattaatgtgaattgcaggacgcattgatcatcgacacttcgaacgcacttgcggccccgggttcctcccggggctacgcctgtctgagcgtcgcttgc

SEQ ID NO: 31141 - DNA, 468 bp, Homo sapiens
  misc_feature 203: n = A,T,C or G
gttaaaaaaaaaattgaggcaaaattcactactttaaagtgtacaattcagtgttggcttactattgaccttggggagagtgcagaccatgtgcagactgaacatcttaatttttttctaaggagaagctagaaatcaagattttgtaagaaatttttattgttaaatgttggcaacttatgaattcatagtgtaaacactgngggccaaacaaattaccactgtgggcagaatttgtcttgtggcttgctgctttacaacctctgatctggggcttgactttctgcagcataacccatgttttctgccctctgagaagaaagttcttacccacgtaaagatttaaccagcctcggcagcatggtgaaacactgtctctacaaaaaagcctcataaaaatcagccaggcatgatggtggtgtgcgcctattgtcccagctgaagtgcaagggtcgcttaagcccagga

SEQ ID NO: 31142 - DNA, 186 bp, Homo sapiens
cattctagtactttatgcattcttgcttttctggttgaatatataatctacttcagagctttgaatttctgtggtgcattctgttattgttatttataaaatattggcatttgagaagggttaaatgtcatttagtataaactaatcaagttatttaccactgtgtaaaactagaaaagatcagac

SEQ ID NO: 31143 - DNA, 394 bp, Homo sapiens
  misc_feature 4: n = A,T,C or G
taancttaaatgggtaaccccctaaggcatatcaaagaagcagattgcatgataaacggaaatagaaaaaaagaacctacatttattttgctttagcatccttactctcaccttttatgagattgagagtggacttacatttccttttttacattttcgtatacttattttttttagccatcattatatgtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagc

SEQ ID NO: 31144 - DNA, 212 bp, Homo sapiens
  misc_feature 6, 14: n = A,T,C or G
tacggncgggcagnacctctactgtcagttttcatttctagctgctttcagggttttatgaattttcaggcaaagctttaatttatactaagcttaggaagtatggctaatgccaacggcagttttttttcttcttaattccacatgactgaggcatatatgatctctgggtaggtgagttgttgtgacaaccacaagcacttttttttttt

SEQ ID NO: 31145 - DNA, 441 bp, Homo sapiens
  misc_feature 18: n = A,T,C or G
cagttgacacaaaatagnactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactgaga

SEQ ID NO: 31146 - DNA, 303 bp, Homo sapiens
ggagggcttactatgaatatcaagatttgtaagctgggcatggtggcacacgcctgtagtcccagttactcaggaggctgaggtgcgaggatcctttgagcccaggagtttttgaggccactctgggcaacatagtgagatcctgtctctaaatacaagaagaaaaaaagacttactataaagctacaatagttacaacgatgcagtttggaaacaatgatagacataagtcaataggacttatgtcccgaagagtccaataacaggcccatacatgtgtggacacttcatttatgatgaaga

SEQ ID NO: 31147 - DNA, 369 bp, Homo sapiens
  misc_feature 21, 26: n = A,T,C or G
tatggccgggcatattgagancttcnaagtccctagaaactggcagaattattgtcttttatcttaaagtgatacaagaggaacttaactccgaatgggttggaggggggaaaaattaggctcattcatttctttcctaatatattattcaataaaccactccaagttaaaagtaaagcaatgacatatagcttgctctgaaaatttgagaacagcctttacaactgaggaaattaaatgttattactggggccatgtgccttccagatatggtgtataagaaacatcacatgatctgtgagaggccagccagtccctgaagcttattctcgttgtgagtgtgatcacaaatctgtgagatctaaggtg

SEQ ID NO: 31148 - DNA, 105 bp, Homo sapiens
  misc_feature 9, 72: n = A,T,C or G
gtatagggnactctcacttacttatgtttggatctccgtaaacacatttttgttcttagtctatgcccttgnacaaacgatgtgctttgaagatgttagtgtata

SEQ ID NO: 31149 - DNA, 349 bp, Homo sapiens
  misc_feature 11: n = A,T,C or G
ggcctcccaantactgggattacaggcgtgacccactgcacccggccagatctcttctttgattctccatttaaaattcctggttctcttcgccccttgcttctagtttcagtaaacaattttcctgccagtcctaatcagtagttcacatctgttccctggtcacctgctccatcctgactcatcccggtcacctgctctgacctaagtcaccttgagttacctgttcctaaccgtccttcccgtcaaactactcaccccgccactctgactcttaccctgccctctttaaaatagccaattggaattggcttagactgtgtggtccaaccttagccaacaggggaac

SEQ ID NO: 31150 - DNA, 400 bp, Homo sapiens
gtaagttattttaaaaaaaagtttaattgactcacagttccgcatggctacggatgtcttaggaaactcacaatcatggcagaaggcacttcttcacagggtggcaggaaagagaatgagggccagcaggggaaatgccaggtgcttataaaaccatcctatctcatgagaactcactgtcacaagaacagcatgggggaactgcccccatgatgcagttatctccaccttgtcccgcccttgataggtggggattattaaaattcaaggtgatatttgggtgtgaacacagagccaaaccatatcacgggaggatcacttgagcccaggagttcaaggctgcagtgagctgtgatcacgccactacactccaacctgggcaacagagtgagacccctat

SEQ ID NO: 31151 - DNA, 140 bp, Homo sapiens
  misc_feature 1: n = A,T,C or G
nacagtgtggccgagcagaggctatgtgctagagggcaaagagttggagttctatcttaggaaaatcaaggcccgcaaaggcaaataaatccttgttttgtcttcacccatgtaataaaggtgtttattgttttgttccc

SEQ ID NO: 31152 - DNA, 381 bp, Homo sapiens
  misc_feature 1: n = A,T,C or G
naatttgggcagctaatgaatgtcatgaaagctgtagaatctacatcaccatccattgctttaattacatgaaaatgctctagtgttgtgatgcactgctgatgtttccaattcaggtacaagtatgctttaaagaagaaataagtttcccaatcagccaatttaactggctacctgttacctcagctgagttagtttaggaagtttacattcgtttctaattctatacttgttttcaggggttttttaaacacatcctatatatcatgtcaatctggcaagaaatatgacttgctttttgctgagcttaattcagatatcagtaaaattaagtcataaaataatcatgtgtcatgtgactttggcaccctatagacatac

SEQ ID NO: 31153 - DNA, 422 bp, Homo sapiens
  misc_feature 4: n = A,T,C or G
agtnaaaatacatgtgaacacagcacatgtacattttttaattgagattttttaagagttcaaatgttaaacatgtttctgcaactctaatgtaccgttttcctggaaacatgctttaaataataattatatatgcccatctgtcttctctagatcataaactacttatacatgtatacatgtatatgcataacatagcatgacagtaataagtgatcagtacattctacatgtgaattgggtgtgcccagatgcattttgttagttctttgatctaccatagttactttggatttataaagtgcttttaaaagggatgttaccttgtcatagtggctcatgtctgtaattccagctacacaggagaatccctgaggccaggaatctgagaccatcctgggccacatagcaagactgtatct

SEQ ID NO: 31154 - DNA, 372 bp, Homo sapiens
gatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaat

SEQ ID NO: 31155 - DNA, 384 bp, Homo sapiens
  misc_feature 11: n = A,T,C or G
ggcgcaatagnatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagag

SEQ ID NO: 31156 - DNA, 458 bp, Homo sapiens
  misc_feature 16: n = A,T,C or G
gtgacaggtgcaaagnaaatgtttaaaatactgtataaaattaccttcaagaccatgtgtataaggtgtatatgaaacataaatgaatttcctgtttagactggggtcccatccccaagatattctcacacgtatgcaaatattccaatatctgaaacacttctcatcccaagcattttggataaggaatactcaacctgtattaacaattctctgaagtcttcagatactgtatctggtctgtcctggtcacaaagcaattcttttagaaacattattctggaagcatgatagcttacaatttaatgccatgatacagtggccactatcaccactgtctgatccttcacaggatgtgtctccgtgtccctctcagccagaaggtttctgattcccacagggatcagtctccatatttacaaattttgatgctttctgaagactgactttacccttga

SEQ ID NO: 31157 - DNA, 341 bp, Homo sapiens
gcttttcctgtggcagcagccgggctgagaggggcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacat

SEQ ID NO: 31158 - DNA, 399 bp, Homo sapiens
ctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagagggaggaaga

SEQ ID NO: 31159 - DNA, 236 bp, Homo sapiens
gatttttgcacattgattttgtatcctgagactttactgaagttgcttatcagcttaaggagattggggctgagaagaaggggttttctaaatatacaatcatggcatctgcaaacagagataatttgacttcctctcttcctatttgaatcccctttatttctttatcttgcctgatttccctagccagaacttccaatactatgttgaataggagtggagagagagggcatcct

SEQ ID NO: 31160 - DNA, 174 bp, Homo sapiens
  misc_feature 10, 13, 19, 28, 43, 61, 75, 86, 93, 108, 130, 138, 155, 170: n = A,T,C or G
ctctggagcnaanaaatantacctaatnttcctcaaggtaatnatggtagaatcctattgnaaaatcacttgctnaggctcatganaggcttnaagattccaaactanaagctggcagggaccctaactnggaattantcaatgaaatactggancacatcgctcctctnatag

SEQ ID NO: 31161 - DNA, 256 bp, Homo sapiens
aaggacattgaagtcgttaaggtccctgagaatggctataacaaatcttagtgatgggaaacatttttataagacatagctaattgttgaagctccactataattgatactaatagcttggtgaaattcctaaatattaacaagaaattgcatgcgtgttttgttttttttaaggactatggcaaggagtctcaggccaaggatgtcattgaagagtatttcaaatgcaagaaatgaagaaataaatctttggctc

SEQ ID NO: 31162 - DNA, 177 bp, Homo sapiens
  misc_feature 3, 14: n = A,T,C or G
tantgtatctaganatattttatatatgcatgtgtattatatgtggtggctgtggttggcagacatttgtagcccctagctactagggaggctgaggcaggaggatcccttgcactcaggagttggaggctgcagtgaaccatcatgacccgtgccactgcaccttcagcccagggc

SEQ ID NO: 31163 - DNA, 184 bp, Homo sapiens
  misc_feature 16, 17, 31, 63: n = A,T,C or G
cccgggaaattcggcnnttatggcccgggcnaggcctgtttctttttttatgacctgtaaacntagatagtgctttattttgttaataataagataatgatgagtaacttaaccagcacatttctcctgtttacactcgggggatttttttgttttctgatgacataataaagacagatcattc

SEQ ID NO: 31164 - DNA, 209 bp, Homo sapiens
tgttgtagcagtctgtccactcaggaccataatataattactgtaaatttggaatatgtttgaattgctggtgggccgagtcctccacatctcgatgggtccctttactcctttttttcccccagaatgttcctgttttcttttgcttgccattttccccatgtggatttaaaatgaatttgtctagttttaaatataattctgtcggc

SEQ ID NO: 31165 - DNA, 207 bp, Homo sapiens
  misc_feature 24, 26, 173: n = A,T,C or G
gctcttcggcacctttcctgtctnangatcggaatgcggggtcgagagctgatgggcggcattgggaaaaccatgatgcagagtggcggcacctttggcacattcatggccattgggatgggcatccgatgctaaccatggttgccagctacatctgtcccttcccatcaatncccagcccatgtactaataaaaaaagtctttgag

SEQ ID NO: 31166 - DNA, 278 bp, Homo sapiens
  misc_feature 40, 41, 52, 53, 63, 67, 69, 135, 150, 162, 249: n = A,T,C or G
cactcatttactgtgaggtaagaaatctgtcttcagcatnnccttgtgtgcnnttcaggatanaatnantaaagatgaatagtaaaaatccaatactaagagataaaactcaggagtcaaaagaagaaatcagancagattacgagcatnattcagaatgtnatgaaaacaaactatgcatagaaacttgtggtattcggccaagacagcatgtaggagaaaatgcaagtattacctttcttgcttgtnttaggataaaaagttgaaaattaacaagc

SEQ ID NO: 31167 - DNA, 484 bp, Homo sapiens
  misc_feature 4, 20: n = A,T,C or G
agancttcccctgaaggtanttgaacttggaaagaaatgccccatctatgtcccttgctgtgagccaagaagtcaaagtaaaacttgctgcctgaagaacagtaacctgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcagggttttgtaaagatgcccgggttttatattttttataggcaaataataagcaaagggagcactgggttgactttcaggtactaaatacctc

SEQ ID NO: 31168 - DNA, 272 bp, Homo sapiens
  misc_feature 16, 20, 28, 36, 55, 61: n = A,T,C or G
tgcctgaggccgggcnagancaccgaangtcagganttccgaccagtctggcccnaagaanattcgggactagtctggccaaccatggtgaaatccccatctctactaaaaatacaaaaatcagctgggcacagtggtgcacgcctgtagtcctagctactcaggaggttgaggcaggagaattgcttgaacccggaagtcagaggttgcagtgagcccgagatcgcacccactacactccagccctgggcaacagagcgagactccatctc

SEQ ID NO: 31169 - DNA, 500 bp, Homo sapiens
  misc_feature 6, 10, 43, 44, 46, 50: n = A,T,C or G
tcggcntttntggcccggggcttttcggcttttcggctcggannangccnaggtgcaacttccttcggtcgtcccgaatccgggttcatccgacacccagcccgcctccaccatgcccgccgaagttcgacccccaacgaagatcaaagtcgtataccctgaggtgcacccggagggtgaagtcggtgccacttctgccctggcccccaagatcggccccctgggtctgtctccaaaaaaagttggtgatgacattgccaaggcaacaggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgaagattgtcaacattgctcgacagatgcggcaccgatccttagccagagaactctctgga

SEQ ID NO: 31170 - DNA, 270 bp, Homo sapiens
  misc_feature 1, 29, 45: n = A,T,C or G
nggccggggttgcccaggctggtctcganctcctgggctcaaganatcctcctgtcttggcctcgcaaagtgctaagtaggattacaggcgttagccaccacacccggctgtaaaaacgtacttattctccagcctcttttgtatacaccatagtaagggatgggagtaatgatgttatctgtgaaaatagccaccatttacccgtaagacaaaacttgttaaagcctcctgagtctaacctagattacatcaggccctttttcacacac

SEQ ID NO: 31171 - DNA, 439 bp, Homo sapiens
  misc_feature 6, 7, 12, 25, 31, 58, 68: n = A,T,C or G
gaggcnnctccnagccgtacctccnaaagangtcagggtttacctcaccgtcattccnagcagaagantgggaaagtcaaaatttccctgaattgctatgtgtcttgggtttcatcccatcccgacattgaagttgacttacctgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatatggaggttttgaagatgccgcatttggattgggatgaattccaaattctgcttgcttgctttttaatattgatatgcttatacacttacactttatgcacaaaatg

SEQ ID NO: 31172 - DNA, 498 bp, Homo sapiens
  misc_feature 2, 8, 366, 425: n = A,T,C or G
tnggcccnggggtgtgaagccaacatggcctgtttatttcaccctgggtgccaggccgggcctgagtcccgaaaagagagtcagcaaagggtggtggattatcattagttcttacaggttttgggatagggggtgaagagccatgtttgcaggcaggggtggatctcacaaagtacattctcaagggtggggagaattacaaagaaccttcttaagggttggggagattacaaagtaccttcttaagggtgggggagattacaaagtacattgaacagttagggtggggcagaaacaaatcacaatggtggaatgtcatcagttaaggctatttttacttcttgtgtggatcttcagttacttcangccatctggatgtatacgtgcaagtcacaggggatgcaatggcttggctttgggctcanaggcctgacagtgtgatcttggctcactgcaaactctgcctcctgggttcaagcaatttttgtgcctcagctt

SEQ ID NO: 31173 - DNA, 385 bp, Homo sapiens
  misc_feature 2, 14: n = A,T,C or G
tngggcccgggtangggggggtcttcgcaaaagctttcctcagcacctttgtttgccccccttaaactttgtcatggagaaaagtggagagcatcctcccatccagtctgtggcacccagctaacaccggatctgagagaagccctgtcctccactcaccctcaccccgccgctgccaccatctcctctgtgccaactccttgtggacccgcaagaaagcatgactttgaaaaagggaagcccattcccgagattttaaaatgttcatggactattccatattaaaagctgtttttgttgtacaaaattcactgatgttcagttctattttattttgccttcagaaaagaagaaagtcaaaaataaaacttttgtgtattacaga

SEQ ID NO: 31174 - DNA, 259 bp, Homo sapiens
  misc_feature 2, 7, 26, 27, 41, 57, 70: n = A,T,C or G
cnggganaggtggtaaaaaactggcnnggtctccttttganaaatttaaagtgaagngttttgtttaccngtaaagtttgaaaaataaaaatgaaagaaaaaaattcccaatgacctgtgcctgtggttggagaactttatttaccaagaatgtttacctcttcctttccccttccattttgaggagctgtgtcacctccctcctcccccccagtgctttgtagtctctcctatgtcataataaagctacattttctct

SEQ ID NO: 31175 - DNA, 425 bp, Homo sapiens
  misc_feature 8, 16, 28, 41, 45, 71, 114: n = A,T,C or G
gttttacngaaaagcnaatactcctttntcctcctcctgantgantacctaaaagaagaaagtttgtgccntttttccttccttccttgtggtaacctgcctgtttccttttcnaagttttctttttgcctgcttgttttggtttctaacaccctattttaggggccttttctcaaatgccctggttttcttggttgctcatttttaaagagtggcttactaagaaaactattgaaagctctaagtttgtttgtggggcctggtggaattgtaggaatcgctgttaggaaagtagctgggctgttacattggaaaaatctgtcagtagcattaagtctttcttatagggatagtcagatgcccctgtgaaggctcttccaatatctacctagagaggtagcatgtgccaccagcattctgggagc

SEQ ID NO: 31176 - DNA, 124 bp, Homo sapiens
  misc_feature 55, 56, 58, 85, 100, 106: n = A,T,C or G
tgccaccaaagcccttcaagtaagccccgatttcaaatccaaacctgggaaagannanggggtatccacctggattgggaaagantcaaaatgaaatganaatganagtgagaaagagaaagtt

SEQ ID NO: 31177 - DNA, 446 bp, Homo sapiens
  misc_feature 13, 37, 39, 64: n = A,T,C or G
tacccccgggaanttcggccatttatggcccgggaantnattaagaaattttttttattttccngcacataaaagttacgtttatactatagtctattatatgtgaagtagcattgtatttttttaaaaaactttacgtgccttaatttaaaaacacttcattggccaggcacggtggctcacgccctgtaatcccagcactttgggaggctctggcaggcagatcacctgagaccaggagtttgagaccagcctggccaacatggtgaaactccgtctctactaaaaatacaaaaattagccaggcgtggtggctcatgcctgtaaccccagctacttgggaggctgaggcaggagaatcacttgaacacaggaggcggaggttgcagtgagccaagatcacgccactgcactccagcctgggcaacaaagcaagactctctcgc

SEQ ID NO: 31178 - DNA, 447 bp, Homo sapiens
  misc_feature 8, 17, 35: n = A,T,C or G
atctgaanatttagttntttgtgttgtatggaacnaatgtctgttggccatttttttaagaaataaaagcaatgtgtgcaccacctgaaaactttcagacagtgcaggaaggcataaaatgaaaagtaaagtttcctttccttctgccttccaaagtgcttcccccacaggtgatccttgttaatggtttctttcatatcattccaaaaaatgtattcatatactaaaacttatagcattccacaaaaaatattatgcatttatgtttgcctgcctagccatttgtctatccacttctcctttttgatttatgcaaatgagattgtttgcccaatgtctttttaaaatacttaattatatatcctaggcatctgtccatatcattacaagtagctttccatcagtttttgtacataacaataccagccatttagaggtctgtctttc

SEQ ID NO: 31179 - DNA, 223 bp, Homo sapiens
  misc_feature 2, 33, 203: n = A,T,C or G
antggcccggggggcttcaagtcatttggggancgctctcagctcttcggcgccacggccccagcttccttcaaaatgtctactgttcacgaaaatcctgtgccaagcctcagcttggagggtgatcacctctacaccccccaagtgcatatgggtctgtcaaagcctatactaactttggatgctgagcgggatgcttttgnaacatttggaaacagcccat

SEQ ID NO: 31180 - DNA, 397 bp, Homo sapiens
  misc_feature 10, 29: n = A,T,C or G
gcatcttcanaaaacctgctgcggcaganctccctcagcccgatggtggcctcctgggtttccttgagtgtcatatgtcctagaaagttgctggctgactcttttttgtctggggccctggggaaagggcttggactgtgaaaagaaatgtggcccctttccatcttcaagagagatgggattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgg

SEQ ID NO: 31181 - DNA, 186 bp, Homo sapiens
  misc_feature 2, 9, 22, 63, 67, 89, 92, 94, 95, 109, 157: n = A,T,C or G
anccaggantgtatgactaganaccaacatttataccatgtggcacatgtacctatactgtgngctnttgtcatatttacagttgaagntgngnnagaacacctctganaaaaattatctattaaatgccaaagaggggtaagtcagggtggggganaaatgggaagggtgtgcttattgctgcta

SEQ ID NO: 31182 - DNA, 490 bp, Homo sapiens
  misc_feature 22, 25: n = A,T,C or G
tatggccggggcaccaaagccngancctaggtgctgagaaggctgagtccatgtgaacagacaggggctctcccattgcccgtacccaccttgtccccaggaaacccccaatttgctcacttcatgatgcgtttggccccacagcagtgcagatcataggaaagggagtacgtatcataaaaagtcgccttcatgttcaggcagccaatgaagtcctgtgggttcagcttgtacaggtcaaaggttacacgggccacatcaatcttcttggcaggcttatgggagagggactgtgggtgcctcgtcccctgcatcgagacaaccagatggttagcacccctaaagactctctacttacgcttatgataggcttatgactactgcattccagcctattagtcaccgcagtgttagatagtgggcgatgattgcacaactttgtgaatatactaaaaaaccctgaattgtaaacttttagaggaaggaaacc

SEQ ID NO: 31183 - DNA, 223 bp, Homo sapiens
  misc_feature 17, 20: n = A,T,C or G
cttgttctaatcttgtnacngtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgat

SEQ ID NO: 31184 - DNA, 500 bp, Homo sapiens
  misc_feature 11, 22, 41, 43, 47, 48, 57, 58, 68: n = A,T,C or G
accccgggaanctcggcatttntggcccgggcatgaggagngngaanntgctgagannactgatgaangctgcagaaccaacgaggtggcccgaatcttccttcaggatatcaagaaaccagactgtgatgacctgggagaagcgggcctgaatgcaatggagtgtgcattacatttggaaaaaaatgtgaatcagtcactactggaactgcacaaactggccactgacaaaaatgaccccccatttgtgtgacttcattgagacacattacctgaatgagcaggtgaaagcccatcaaagaattgggtgacccacgtgacccaacttgcgcaagatgggagccgcccgaatctggcttggcggaatatctctttgacaagcacaccctgggagacagtgataatgaaagctaagcctcgggctaatttccccatagccgtggggtgacttccctggtcaccaaggcagtgcatgcatttggggggtttcctttaccttt

SEQ ID NO: 31185 - DNA, 500 bp, Homo sapiens
  misc_feature 3, 6, 31, 46: n = A,T,C or G
ganccntatggagctttaatttattaatgcnaacagtaccctaacnaacccacaggtcctaaactacccaaaccctgcattaaaaatttcggttggggcgaccctcggagcagaacccaaccctccgagcagtacatgctaagacttcacccagtcaaagcgaactactatactcaattgatccaataacttgaccaacggaacaagttacccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagacccggagtaatccaggtccggtttctatctacttcaaattcctccctgtacgaaaggacaagagaaataaggcctacttcacaaagcgccttcccccgtaaatgatatcatctcaacttagtattatacccacacccac

SEQ ID NO: 31186 - DNA, 170 bp, Homo sapiens
  misc_feature 4, 6, 10, 16, 32, 34, 112, 123: n = A,T,C or G
gtangngaangggagnacaggttttgtgggancncctttgggttttccttttttgcgtgtggcagttttaagttatttagtttttaaaatcagtacctttttaatggaaacnaaccttgaccnaaaaatttgtcaccagaaattttgagacccattaaaaaagttaaatg

SEQ ID NO: 31187 - DNA, 386 bp, Homo sapiens
  misc_feature 3, 12, 47: n = A,T,C or G
aanttccggccntttatggcccggggagccagtgaaagattcagaanattctgattttcaggaatcaggagttagtgaagaagttagtgaatccgaagatgaacagctgcccagaacaaggtctgcaaagaaagcagagttggaagaaaatcagcggagctataaacagaaaaagaaaaggcgacgtattaaggctcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaaccc

SEQ ID NO: 31188 - DNA, 358 bp, Homo sapiens
  misc_feature 7, 41: n = A,T,C or G
tcggccnttatggcccgggtatcctttgctaggtaaaagangttcccttctcttcctagtttgttgagagttaccacctataaaaactatcttgattgtggaattttgtgtaatgctttttcttcatctgttgatttgatcatatggtttttcttgttcagttagttaatgtgacgaattacatcagtttacaaatgttgaaccagccttgtgttcctgggatgaacctcacttgatcatgatgtattatacttttataggttaagagattgtgtattcatgagaaattggcatgtagatttcctgtaatgtttatgtctagttttggtatcgggataatgttgggatcctggaatga

SEQ ID NO: 31189 - DNA, 335 bp, Homo sapiens
  misc_feature 2, 23: n = A,T,C or G
antagttgaagttaattttgccngtgaaatgtagggaaagaaaaatgtttgaaatttaaattattcagatagctaaattcttaatcctaaaatttaaacccccttaattctgtctgtagtgttatatcaagactttttgatagtcatgaaactgagtaaaactttattcagattacttaaaaacagcttttcctgtggttaataacaccctttattttgaacagagtactcttaagcaacttatattgtgctgattaaagatttaatctgtgcatattttttaccctgttgtttatttaggttttgataactgtgaaataaaccataattaaatc

SEQ ID NO: 31190 - DNA, 481 bp, Homo sapiens
  misc_feature 433: n = A,T,C or G
cattatggccgggcagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccangtcggtttctatctacttcaaattcctccctgtacgaaaggacaagag

SEQ ID NO: 31191 - DNA, 307 bp, Homo sapiens
  misc_feature 2: n = A,T,C or G
antaatggtagatgctgcagaagaaagatcaatgaccttgagtgcatagcaatagaatctgtccaaaatgaaaagactgaaaaagttgagaagagctgcagtgaccctgtgggacaatatcagtctaatacacgcataactggagtcccagaagtagaagaaatggagggacaggaaaaatatatgaagaaataatggcaaaaattttatgaagtttgacaaaattaaaacccagaaatacaagaagcttaaactccagagaatcaaaacgtagccataccgagaagcacatcataattaaattgtc

SEQ ID NO: 31192 - DNA, 269 bp, Homo sapiens
  misc_feature 260, 261: n = A,T,C or G
gtatgtgtcccgaatcccagtcgtactgattctagtggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttnngtgtgaat

SEQ ID NO: 31193 - DNA, 464 bp, Homo sapiens
cgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaaggatgctaaattccgtctgattctaatagagagccggattcaccgtttggctcgatattataagaccaagcgagtcctccctcccaattggaaatatgaatcatctacagcctctg

SEQ ID NO: 31194 - DNA, 464 bp, Homo sapiens
cgggcgcggtggcgcgtgcctgtagtcccaagtagctaggaccacaggtgcgtgtcaccatgcttggctaatttttttgcagaaacgaggcctcactatattgtccaggctgagtggctcttttattaaccagtcattacactgcggaacagcctacatagagtacttgctctcgccctgtgaattttctttcatgagggagtcaatatgtagtggaaagaagcatgtagcaaaaaaagacaaccttgatctttaataaaaaagaagttggtttatttccaaaataaatcccctgacaaaaaacctggtgatgttaagcaattgactgtcttagagtccagcagaagaccttagacaaaaaaagcagaacccactggagtagaaaaggaagcatgtagcatatactcagtagtgaaatttaattttactgactgttaggtatctatgccaatttgttttcatac

SEQ ID NO: 31195 - DNA, 309 bp, Homo sapiens
  misc_feature 5, 9, 23, 54: n = A,T,C or G
cgggnccantcaataaaggaaanctgttaccccagttgttttgtacccttaccntataaaaaagaataggcaccaaccttaaatttataattattttagttataatgaatgatttgtgataggaaaaatttaagggtgacaatcctcagaaaattaaaaaaattaaaatatatgtgattttgatgaaaaaggtctacccatagggaggatttagaatgaaatgacctcttaattcttatgtcttaattgttgccttttaattacgagatagggaaaagttatcaaaactgaagatacatcagtggatgt

SEQ ID NO: 31196 - DNA, 299 bp, Homo sapiens
  misc_feature 18, 45, 49, 298: n = A,T,C or G
agccttttcattttctcncatatacctacaaattctataaagaangaanattaatttaaaaaaacctaagatgtttttctcttctggcttcataaatgcccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatnt

SEQ ID NO: 31197 - DNA, 443 bp, Homo sapiens
  misc_feature 4, 39: n = A,T,C or G
tatngccggggttcccttttccccgtacttcccctagancttaaaatgttacatgaagttgagtttgtggctagtgatttacatgcgaacttgttgttttaaaacaaagcccccaaaactgtggcagtgaggataatacagcaaaaacagtgaggctattccaagtagttgaaagattttcattgtgagtgagaagccattaatgatggttgtggttgttccttttttcaaaggttttctcatttttgataagatgatattttactacatttaatagaattatgcttagataagatgcttttttcattgaattggcctggtccttgtttttatgtgggcctttgaatctgggttgatttgaaactacctactgctgtcctctatactgtctgcagagacctgaacctgtagatcatttagaagtcgtgtactagctaggaccc

SEQ ID NO: 31198 - DNA, 487 bp, Homo sapiens
  misc_feature 19: n = A,T,C or G
ctgtttttgaactttatcnatctgtatgtattttttatcttgtttctttcaccctctctgtaacattcttccaacattcttccaagttactgcatttttcaagttactgcattcttccaaattagtagtagaacattcttccaagttactgcatttatctctagttcattcattcttgttactctataactctatgacccctgtgtagggccaggcaccggtggcttacaccctgtgatcccagcactttgggaggctgacgtgggtggatcacgaggtcagaagttcaggatgagcctggccaaaatggtgaaacccagtctctactgaaaatacaaaaattagccaggcgtggtggccgggtgccctgtaaggccagccactcaggagactgaagcagagaattacttgaacccagagtgggaaggttgcagtgagctgaaatcacaccactgcactctagcctgagcgacagagcaagactcca

SEQ ID NO: 31199 - DNA, 375 bp, Homo sapiens
  misc_feature 6, 362: n = A,T,C or G
agaaantaaagaactctgctgtatcttgtataccaactgattgggtaaaggttggaagcacaaaagctgtgagccgctttcactctccttttattgtagaaaattacagacatctgaatcagctccgggagcagctagtccttgactgcagtgctgaatggcttgattttctagagaaattcagtgaacattatcactccttgtgtaaagcagtgcatcacctagcaactgttgactgcattttctccctggccaaggtcgctaagcaaggagattactgcagaccaactgtacaagaagaaagaaaaattgtaataaaaaatggaaggcaccctgtgattgatgtgttgctgggagaacanggatcaattatgt

SEQ ID NO: 31200 - DNA, 497 bp, Homo sapiens
  misc_feature 10, 11: n = A,T,C or G
cgggggagtnnccctggggcatgcagtgtgccctctgcccccctgaaggattcagatgactatgctcagctgtgtaacatcccccgtgacgggacgccggcagccatatggacgggacgcccttggttgacttcagtgaacagtatactccagaagcccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgaccctgtgtcgatgtaaatgaatgcgatgaagttgaacaacccggatgtctctctgcaagaatgccaagtgcattaacaccgatggttcctacaagtgttttgtgtctgccaggctacgtgccttctgacaagccaaactactgcactccgttgaataccgccttgaatttagaag

SEQ ID NO: 31201 - DNA, 154 bp, Homo sapiens
  misc_feature 16, 19, 23, 34: n = A,T,C or G
gggccatcctgtaaangtnaacnaataaaaaccnaattatggggctgcttttgtcacactagcatagagaatgtgttgaaatttaactttgtaagcttgtatgtggttgttgatctttttttccttacagacacccataataaaatatcatatt

SEQ ID NO: 31202 - DNA, 470 bp, Homo sapiens
  misc_feature 13: n = A,T,C or G
aatgaaattgatnagttgatgaaccaaatgcaacagatcgagacccagcaaaggaaatttaaagcatctagagatagcatattatcagaaatgaagatgctaaaagagaagaggcagcagtcagagaaaaccttcatgcctaagcaacgtagcttacagagtttggaggcaagcttgcatgctatggagtctaccagagagtcattgaaagcagaactgggaactgatttgctttctcaactgagtttggaagatcagaagagtgtagatgcactgaatgatgagattcgtcaacttcagcaggaaaacagacagttgctaaatgaaagaattaaattagaaggtattattactcgagtagagacttatctcaatgagaatctgagaaaacgcttggaccaagtagaacaggaacttaatgagctgagagagacagaaggggggtactgttctcacagccacaacatcag

SEQ ID NO: 31203 - DNA, 103 bp, Homo sapiens
  misc_feature 5, 7, 9: n = A,T,C or G
ggagnanantggaccatccagaagccatgaaagttcaaaggatccccaccaaagattcaacctcaaagaggtcctctctgaggcatataacccaaacctgacc

SEQ ID NO: 31204 - DNA, 398 bp, Homo sapiens
  misc_feature 7, 8, 45, 52, 389: n = A,T,C or G
tcggccnnttaatgggcccggggttcatttctgtcttgttttacnaaaggcnaacatcacattttattttattctgtcacctgtcttctcagtgcccttctgtgttgtctcaattcagagtatctcctgcaaatagttctctttcagttttcagaggttatagggttacaattcataatgtttgaatgtgtaactctttatttttgttattatttttatataaaataaaaattattaactaaattttatgtgttattcctccactcccaactcaccattagtatcttatgatattgtctaatttattacatgaacacagtatatttctcttcacttatttatgtcattaatttctttcagcaatgttttgtagtgtttgggtgtataanattttgcac

SEQ ID NO: 31205 - DNA, 435 bp, Homo sapiens
aaggatattcctggactgactgatactacagtgcctcgccgcctgggcccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataaggatcagactctt

SEQ ID NO: 31206 - DNA, 182 bp, Homo sapiens
  misc_feature 11, 22, 52: n = A,T,C or G
acattctttantttgagtctanaagggcttacaaatcacctgtctttgaganaagtttcttaattcaccaggtttgtattcagttgtacctaggtttggtgaaggatgtcatcctagatatacagtgtagaccgtgcctttatgaaacataccttcttcttagggacatttttaaatacccc

SEQ ID NO: 31207 - DNA, 149 bp, Homo sapiens
  misc_feature 8, 13, 71, 148: n = A,T,C or G
caccgaanaaaanctctacctctctatactaatctccctacaaatctccttaattataacattcacagccnccagaactaatcatattttatattcttcttcgaaaccacacttatccccaccttggctatcatcaccccgatgagana

SEQ ID NO: 31208 - DNA, 290 bp, Homo sapiens
ggaggatttcagagttaaccctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtc

SEQ ID NO: 31209 - DNA, 325 bp, Homo sapiens
  misc_feature 14: n = A,T,C or G
atggcccgggattncagtaggaataggggttggaggattaagagggtttttcttaaatattagcttttaatgtgtacaattaggaaatttttttaagtgaggactctctacccttgccgtatctaaggagctgaggtaatacagatccaaggagaattgtatagcaagaaaaaaacagtcaactacagaaactcttaaaaggaataaaaacccaaagttccttattttgaaattgtcaaagaacaaagcggtgtttttcttttaaacaggtgatcacgtttcgtgttcatactcaacgttaataaaaggagagagtttgtagtga

SEQ ID NO: 31210 - DNA, 373 bp, Homo sapiens
  misc_feature 10, 40, 301, 323, 338: n = A,T,C or G
tcggccaatntaatgggcccgggtgcccccttcatttacntaaaatattatactagcatttaccattctcacttctaggaatactagtatatcgctcacaccctcatatcctccctactatgcctagaaggaaataatactatcgctgttcattatagctacctctcataacccctcaacaccccactccctcttagccaatattgtgcctattgccatactagtctttgccgcctgcgaagcagcggtgggcctagccctactagtctcaatctccaacacatatggcctaaactacgtncataacctaaacctactccaangctaaaactaatcgncccaacaattatattactaccactgacatgacttt

SEQ ID NO: 31211 - DNA, 395 bp, Homo sapiens
  misc_feature 3, 20, 38, 44, 47, 56: n = A,T,C or G
atnggcccgggggtccgccnatggtgaaagcctgagcnaagagnccnagcagagtnctacagcagcctcttcaaggggagcccagtttgccattcgctggggcctttattccctcttgtgatttaccctgggatttaagaggggtgcagatcccggaatgcctgaaccaactgttttgagccctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatggtatcagaataaaatgtttttaacagtg

SEQ ID NO: 31212 - DNA, 347 bp, Homo sapiens
  misc_feature 14, 81: n = A,T,C or G
aggagccgccaganatcggccctactagatgcagagaccccgcagagctgcattgactacccagatttattttttaaaccnagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatg

SEQ ID NO: 31213 - DNA, 353 bp, Homo sapiens
  misc_feature 3: n = A,T,C or G
agngaaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttc

SEQ ID NO: 31214 - DNA, 441 bp, Homo sapiens
ggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggctggaggtgggcaaaggggaagtaacagacacacgatgttgtcaaggatggtttttgggacctagaggctcagtggtggggagagatccctgcagaacccaccaaccagaacgtggtttgcctgaggctgtaactgagagaaagattctg

SEQ ID NO: 31215 - DNA, 172 bp, Homo sapiens
  misc_feature 20: n = A,T,C or G
cacccccgggaattcggccnttatggcccgggggaaaggagcagactggttcctaactctctccctcctcctgcccacacacatcaaaagaatcttccctacacccttctctgcctttattttttgatttgtgcaacttgtaactaggtgtttatggaataaaggagaatgg

SEQ ID NO: 31216 - DNA, 253 bp, Homo sapiens
  misc_feature 4, 6, 30: n = A,T,C or G
gaananggtgggtgaaatgaaggttcaganggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcat

SEQ ID NO: 31217 - DNA, 130 bp, Homo sapiens
  misc_feature 7, 13, 48, 60: n = A,T,C or G
cggccantttatnggcccgggataaaaatcttgggagtaaaaaagaantgccaaaaagcnagaaaattattaaagcatacccgaaaattagcacctgcagtggcaccccagataacttccagaatgaacc

SEQ ID NO: 31218 - DNA, 458 bp, Homo sapiens
aagtgataaaatgacaaaaccaatagactttgatacattaaacaaatatgatgtaatacctagagcagctactaaaaaagttgtacaaacaaaaagtaaaacagtagagttaagccctagcataccaattattgcagtagctgtaaatagtccaaatgcaccaattaaaaaacagattgttacctttttttgtggtaagaagacataaaatctattctcttagcaaaatttcagtatatgatgtaatattatgaactccagccctcatgctagtacattacatctctagaattctttatcctatataactgcattatgctatggtacacaggatggtttccttgatttcttgtttggatagatcattatttggtgtaaagaaatgcaaatgctggtttgtttgggttgcgtattctgcagccttactgaattcatttattaattctaacagatttttg

SEQ ID NO: 31219 - DNA, 175 bp, Homo sapiens
  misc_feature 1, 12: n = A,T,C or G
ngccggggtacnactcttagcggtggatcacctcggctcgtgccgtcgatgaaagaaacgcagctagcctgcgagaattaatgtgaattgcaggacacattgatcatcgacacttcgaacgcaccttgcggccccgggttcctcccggggctacgccctgtctgagcgtcgctag

SEQ ID NO: 31220 - DNA, 261 bp, Homo sapiens
  misc_feature 2, 14: n = A,T,C or G
cnttatggccgggngctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgagat

SEQ ID NO: 31221 - DNA, 416 bp, Homo sapiens
  misc_feature 8, 15, 27, 28, 34, 52, 54, 64, 66: n = A,T,C or G
tccggccntttaatnggccccggggannatcccngttggcctccgcccgganancggggaagananagccttaagtgaaggcagtttttatggcgttttgtagtaaattctgtaaaatacctttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtctagaagttgataaatgtgtacagggtccttttgcaataaaactggttatgac

SEQ ID NO: 31222 - DNA, 111 bp, Homo sapiens
  misc_feature 8, 27, 28: n = A,T,C or G
gggaaatngggttcgattccggaaganngagccctgagaaacggctaccacatccaaggaaggcagcaggcgtgcaaattacccactcccgacccggggaggtagtgacgt

SEQ ID NO: 31223 - DNA, 228 bp, Homo sapiens
  misc_feature 2, 13, 24: n = A,T,C or G
ancagaaatgtcntataaatttcnttgaagtcgaatgatactgagaagcctgtaaagaggagaaaaaaacataagctgtgtttccccataagtttttttaaattgcatattgtatttgtagtaatattccaaaagaatgtaaataggaaatagaagagtgatgcttatgttaagtcctaacactacagtagaagaatggaagcagtgcaaataaattacatttttccc

SEQ ID NO: 31224 - DNA, 459 bp, Homo sapiens
ggaaaccacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgttttgagactttcaatgt

SEQ ID NO: 31225 - DNA, 330 bp, Homo sapiens
ggccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagc

SEQ ID NO: 31226 - DNA, 435 bp, Homo sapiens
gctttttcgtctgggctgccaacatgcctccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactataaagttctgggaaagggaaagctcccaaagcagcctgtcatcgtgaaggccaaattcttcagcagaagagctaggagagattaaga

SEQ ID NO: 31227 - DNA, 117 bp, Homo sapiens
  misc_feature 2, 3, 27, 41: n = A,T,C or G
gnnttttcacccccgggaaattcggcnttatggcccgggancgatctgtgtgtctatttttgcaccagtaccgtgctattttggttactacagccttgtagtatagtttgaattcac

SEQ ID NO: 31228 - DNA, 243 bp, Homo sapiens
  misc_feature 242: n = A,T,C or G
gttcagaaaatatcagaatctggaggacagaaatacggtctaagactggaggagagggaaacataaggttagtcgttggttactatggtatttttagcttttgttttggtgatagttcatggagcttactatattattgaatttagctaattagataattcaatgaaaaataagaatactttgtatgaaacaataatgattttgtcgtgaaccaaggattatgattattttcagtccatgcnc

SEQ ID NO: 31229 - DNA, 357 bp, Homo sapiens
  misc_feature 32: n = A,T,C or G
gtgcattacatttggaaaaaaatgtgaatcantcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccact

SEQ ID NO: 31230 - DNA, 224 bp, Homo sapiens
  misc_feature 7, 32: n = A,T,C or G
gaaggcnttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatg

SEQ ID NO: 31231 - DNA, 234 bp, Homo sapiens
tgatgaacagatgttcccttgtcgattcattaaaataggtaagattttagcattctgaaatagaaacaaattcttgatatcatcagtcagcaaaccatagcccatagaccaaatcctgcaggcctcttgtttttttaaatacaattttatgggaatattgctgcgctggtttgtttacatattgtctgtatctgcttttgtgctacaaaagtagacttgagtagttgcaagaga

SEQ ID NO: 31232 - DNA, 203 bp, Homo sapiens
  misc_feature 6, 31: n = A,T,C or G
gaaaantccggaaggcaccattctaacaatngacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaaaaataaagtgccattctcc

SEQ ID NO: 31233 - DNA, 268 bp, Homo sapiens
acctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttgtacccacatgacttattatgc

SEQ ID NO: 31234 - DNA, 344 bp, Homo sapiens
  misc_feature 23, 25: n = A,T,C or G
aactttttggtttccagagcctntntgcctaagaactatgcatcctgcctctgaaattcatattgatcacctaccgtgtaccagaaactaacagctctcctacaatgctcctattgtagtaaggcagacaagagggttctagaaagtgatcgaggcctggtgcagtggttcacgcctgtaatctcagcactttggggggctgaggcaggcggatcacttgaggtcagtagttggacagcctggccaacacggtgaaaccccgtctctactaaaaatacaaaaattagctgggcatcgtggcacgtgcttgtagtcccagctacttgggaggctgagacaggaga

SEQ ID NO: 31235 - DNA, 382 bp, Homo sapiens
ataaacaagaagctagctgctctacggtcttctttgcttaagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtg

SEQ ID NO: 31236 - DNA, 284 bp, Homo sapiens
  misc_feature 23, 257: n = A,T,C or G
tgaacattgcaatagaaatccanttggatacgacaacttgcacgtattttaatagcgtcataactagaactgaattttgtctttatgatttttaaagaaaagttttgtaaatttctctactgtctcagtttacattttgtatatttgtatttaaatgaaagtgagactttgagggtgtatattttctgtgcagccactgttaagccatgtgttccaaggcattttagcggggagggggttatcaaaaaaaaaaatgngactcaagacttccaaagcctcaaatg

SEQ ID NO: 31237 - DNA, 260 bp, Homo sapiens
tctggctcaaggagaatttgtaactttagtaggtacgtcatgacaactaccatttttttaagatgttgagaatgggaacagttttttttagggtttattcttgaccacagatcttaagaaaatggacaaaacccctcttcaatctgaagattagtatggtttggtgttctaacagtatcccctagaagttggatgtctaaaactcaagtaaatggaagtgggaggcaatttagataagtgtaaagccttgtaactgaaga

SEQ ID NO: 31238 - DNA, 472 bp, Homo sapiens
  misc_feature 31, 32, 33: n = A,T,C or G
gaaggcgaagccaccccagttaacctcacannncctgccaagctggaagttaagttttcctggtttatgccgtcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccccataaagacaaaccaatcaaccatgacaaaggaagttgacctgaacatgtaaccatgccctaccctgttaccttgctagctgcaaaataaacttgttgctga

SEQ ID NO: 31239 - DNA, 144 bp, Homo sapiens
atgacgagtccggcccctccatcgtccaccgcaaatgcttccaggcggactatgacttagttgcgttacaccctttcttgacaaaacccaacttgcgcagaaaacaagatgagattggcatggctttatttgttttttttgttt

SEQ ID NO: 31240 - DNA, 327 bp, Homo sapiens
  misc_feature 6, 7, 29, 31: n = A,T,C or G
gaacanngctgggctaatggggtggcctntntcactgaggctgcggtgtgtgcgagcactggaaagggagagttcccgtacctgtgttggagagcagcttagtggcttccagaaccttctctgtgtagactcctggctcatagttgtccatctctgaggtgactacgtgaatgacccgggctgcccggcctcgaattgcaccagctgtgcggtccaggccatccacatccttctcttggagagcaatgacacatttgttcacatcttccaaaatgtgattctctggagaacaagcaaaaagttgaatgaggaaggaggctttctatg

SEQ ID NO: 31241 - DNA, 383 bp, Homo sapiens
  misc_feature 20, 22, 47: n = A,T,C or G
agaatttaatttctgggtgntntttaataggtcacagtacagtcatntatatcactgcaacaagttagaaaaccacaattggatgaactttaaaaatcaatactaaaaaaaatattggagagctatggatgtaatgaggactagatgaattagaattccagaaatagaagagatctttataggtgagcagaggattgctgacatttgctgattctggacacacactgaaggaaaaggaaactagagaggaagtgcattttactaaaactgcaacatatccctggcccagttcaattcctgattggactgaggtgatcagcctatcttatcccttttgcctaatagaggaaatagacagctcttactgaggagatatattctgg

SEQ ID NO: 31242 - DNA, 264 bp, Homo sapiens
  misc_feature 25: n = A,T,C or G
ctgctcaactgctcctgttagtatngacaaggatgcatttcatggctgatgagcacagttttgacttgtgtatccagtggaggtgttccctttggcaaatggtcctcctttttaactaatttttatgttttaattgtctgtattggtattgtgggagtaaaagattgaaagacttatgattgtcctttctatagttgagaaaccaaggcagtatcatgagcaggaagaaacacctgagatgatggcagcccgcattgacagaga

SEQ ID NO: 31243 - DNA, 122 bp, Homo sapiens
  misc_feature 7, 31, 88: n = A,T,C or G
aattctntttctggtgatctcagaactttgnagaactgaattatagcttcccttcacaaaatgctgggggaactctttataatacttnagctaagcattatggtccctgatgaaatgtgcca

SEQ ID NO: 31244 - DNA, 377 bp, Homo sapiens
  misc_feature 21: n = A,T,C or G
atctttgaacatattattaancggatggcaccaagcattatgaaaagcctaatggaccacaccatccctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatga

SEQ ID NO: 31245 - DNA, 319 bp, Homo sapiens
caacatggtgaaaccccatctctactaaaaacacaaaaattagctgggcatggtggtgggcgcctctagttccagctacttgagaggatgaggcaggagaatcgcttgaacccgggaggtggaggatgcagtgagccgagattgtgccactgcactccagcctgggcaacagagtgagactccatctcgaaaaaataataatctttttggggtgatggaaatgttctaaaactgaattgtgttgagggagccacaactctataagtttactaaaaatattcaaattaaacactttaaatgggtgaattttatggcatat

SEQ ID NO: 31246 - DNA, 167 bp, Homo sapiens
  misc_feature 167: n = A,T,C or G
tgtacatgttggtcatgtgaaaggaattatatatgtatagtattacaagtatttttgcatttttacaagattgaaatttgtagcattttgtattatttacacagaatttatttgtatatgaaactcataccataatttaattcgaataaatgaaacttttctatatn

SEQ ID NO: 31247 - DNA, 104 bp, Homo sapiens
  misc_feature 1: n = A,T,C or G
ntacatgactatataatttgcgtcaatactgctcagtgtgccatatttaaatttacatgactatattgtgatattcttttcaaaataaagtttatttgggagat

SEQ ID NO: 31248 - DNA, 206 bp, Homo sapiens
  misc_feature 7, 31, 33: n = A,T,C or G
gaatctnagttcaactttaaatttgcccacntnaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatccct

SEQ ID NO: 31249 - DNA, 259 bp, Homo sapiens
  misc_feature 7, 24, 101, 145, 159: n = A,T,C or G
cgttgtngcgagtcaaggcacctngcacgggaatgcacaattgaggctacagcctaattattttcctttgtcgcccctcctttttctgattgatggttgtnttattttctctgaatcctcttcactggccaaaggttggcagatngaggcaactcccangccagtgagctttacttgccgtgtaaaaggaggaaaggggtggaaaaaaaccgactttctgcatttaactacaaaaaaagtttatgtttagtttggtaga

SEQ ID NO: 31250 - DNA, 120 bp, Homo sapiens
ctgtttggaaagacccaggagcaagccgcccaaagaactggtcaatgagtggtcattgaagataagaaaggaaatgagagttgttgacaggcaaataagggatatccaaagagaagaaga

SEQ ID NO: 31251 - DNA, 254 bp, Homo sapiens
gtgtaatatatgtgtgtgtatatctatataatgtatataataaaacactgcatgataggtaaaatgaatgagcctgtctatgtgtataagcaaggacaaatcccaggaacaatgttgggggaaaacaatatgtgtaacatgatcccatttaaatgttaaacacaatactgtatatttttattacaatatatatgtttacagcatataaaatatggatggaaatcacagcttcagaagagcagtgaaggatacag

SEQ ID NO: 31252 - DNA, 329 bp, Homo sapiens
tatttaatgtttgattgggttgaccaaatgagattcagcaattcacaagtgcattaatataaacagaactggtggcacttaaaatgataatgattaacttatattgcatgttctcttcctttcacttttttcagtgtctacatttcagaccgagtttgtcagcttttttgaaaacacatcagtagaaaccaagattttaaaatgaagtgtcaagacgaaggcaaaacctgagcagttcctaaaaagatttgctgttagaaattttctttgtggcagtcatttattaaggattcaactcgtgatacaccaaaagaagagttgacttcaga

SEQ ID NO: 31253 - DNA, 162 bp, Homo sapiens
gagtcctcaacttgtgggatctacactatctccaggtagatagcgctgaaactgaattggaggacacccagcagacatccactgcttggcgtgtggagaaaagcacccacctttgatcacagacatcttctgtattgaagattattgtggtggtgtgagagt

SEQ ID NO: 31254 - DNA, 222 bp, Homo sapiens
agcgggcttgatgtgcttaaaagctgccataagctgtggccatgactactgaagtaggctctgtgtctgaagtgaagaaggactctagccagttaggaacagatgcaaccgaggaaaaacctaaagaagtagtagaaaatcagcagaatcagtcttccgatccagaggaggaaaaaggttcccagccacctcctgcagctgaaagccaaagtagtctacgcc

SEQ ID NO: 31255 - DNA, 338 bp, Homo sapiens
  misc_feature 2, 23, 27, 31, 149, 252, 309: n = A,T,C or G
gngtccctgtgggtggacgtgcntggngatnggcaggatcctggtatccgctaacaggtcaaaatgcagatcttcgtgaaaacccttaccggcaagaccatcacccttgaggtggagcccagtgacaccatcgaaaatgtgaaggccangatccaggataaggaaggcattccccccgaccagcagaggctcatctttgcaggcaagcagctggaagatggccgtactctttctgactacaacatccagaangagtcgaccctgcacctggtcctgcgtctgagaggtggtatgcagatcttcgtgaanaccctgaccggcaagaccatcaccctgga

SEQ ID NO: 31256 - DNA, 272 bp, Homo sapiens
  misc_feature 5, 16, 51, 62, 68, 70, 86, 117, 154, 172: n = A,T,C or G
tatanacttttttaanataacatcttctgagtcataaccagcctggcagtntgatggcctanatgcananaaaacagctccttggngaattgataagtaaaggcagaaaagattatntgtcatacctccattggggaataagcataaccctganattcttactactgatganaacattatctgcatatgccaaaaaattttaagcaaatgaaagctaccaatttaaagttacggaatctaccattttaaagttaattgcttgtcaagctata

SEQ ID NO: 31257 - DNA, 154 bp, Homo sapiens
tcttccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgc

SEQ ID NO: 31258 - DNA, 360 bp, Homo sapiens
  misc_feature 18: n = A,T,C or G
agtgagattattgtttgngcactttaaatcctaagaacattgtcaggtttattgctcttgactattctgctccagcattttgaagactccttccctgaccaaatgctacaataacaacaataatattatctgggtattatgtttatgttttatataatatttttacattcatgattttagtgactgttagtgtccacatttatactgcatgttgctagaagtactgcttgatcttttcagtagtgccatggtaataaaacacctttcttgctttataatttaaatatatctcactatttcttaaaagatactttgcctggtgacatgagcaaaattggcagagcagggaactccaaaagc

SEQ ID NO: 31259 - DNA, 274 bp, Homo sapiens
  misc_feature 26: n = A,T,C or G
atgaataagctatgcaaggtatttcngtaatatactgtggacacaacttgcttctgcctcatcctgccttagtgtgcaatctcatttgactatacgataaagtttgcacagtcttacttctgtagaacactggccataggaaatgctgtttttttgtattggactttaccttgatatatgtatatggatgtatgcataaaatcataggacatatgtacttgtggaacaagttggattttttatacaatattaaaattcaccacttcagagaatg

SEQ ID NO: 31260 - DNA, 119 bp, Homo sapiens
tgggttcaactaaagcgccagcctgctccacccagagaagcacactttgtgagaaccaatgggaaggagcctgagctgctggaacctattccctatgaattcatggcataataggtgtt

SEQ ID NO: 31261 - DNA, 319 bp, Homo sapiens
  misc_feature 8, 49, 58: n = A,T,C or G
aggctggntaagggaagatggcctataaaaacgtgtgttatcaaccagntactgtttnggatcgcgctggggactctggtggtagagtagaatttgcactgaggactgcccttaacaaaggatggggccgggtgtgtggctcatgcctgtaatcccagcactttgggagactgaggcgggtggatcacctgaggtcaggagttcgagaccagcctggccaacatggtgaaacccgtctctactaaaaatacaaaaaaattagccaggcgtggtggtgcatgcctgtaatcccagctacttgagaggctgaggtaggaga

SEQ ID NO: 31262 - DNA, 324 bp, Homo sapiens
  misc_feature 1, 9, 32, 61, 131, 132, 133: n = A,T,C or G
natctcctnatattaaaaaaactattataatnatctttcccacatatcaaactccactggntttgttcccatgtttctttcatacttcagaaagacgagaatccaggacttgaatcgtatcttcccactgnnngaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgcccccagacagccaggacttgggtcaacatggattagaaga

SEQ ID NO: 31263 - DNA, 315 bp, Homo sapiens
acgagaacatgcctctcgcaaaggatctccttcatccctctccagaagaggggaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttga

SEQ ID NO: 31264 - DNA, 319 bp, Homo sapiens
gtttcctcagacgtcagtccagctgccgtggcaaagatccatttcacataataaagtgccctattacatcaagtaagttgattttaattctcctttatgataccaagaaaatcatgttttattgataacttaagaggcttctctccccataacttttaaaaatagaattcagtcctattatctgaaagaaactgtgatatagttaatattaaaaagaaactacttttaacatgagaattatatttttcatgtatcagattagggatataggtgtgtttagctgatatattttaaagtagagatttaaatatttggggac

SEQ ID NO: 31265 - DNA, 298 bp, Homo sapiens
tgtagcaactctcccagggaacacactagggtacttagggaggtgctttgtggagcatgttgaagctttgagatctgagcaggaggcagtgatgtccctggtctattcagggaaagatttcagtgtgaaatggtaaacatccaattgacaggatttagattttgcttagtttttctgctttttaatgtttctatcccccatctcagtgttttctttatccatcccagtgatgccttatttgaaactgggcttaaactgcaaaaagaatgaagttggatttaggaagctgttagatcat

SEQ ID NO: 31266 - DNA, 359 bp, Homo sapiens
ctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatga

SEQ ID NO: 31267 - DNA, 305 bp, Homo sapiens
  misc_feature 25, 26: n = A,T,C or G
ctcaatggtttgtaggaactctatnnatattataggagctctttatatactctgatttgagctgccagtgcaccacagggacaccaaaggttcagatttctttcaacttcaaggatcctttgcatggttcagtgtgcatgggaggaaaatgagaagcagaaggttggggcactaagcaaacacctttcaggttcctgggctttgttctggctccagcctccccagccaggccctgttcttaggaagcctccctttgctgtggtcttcagtgtaagacaggggtccccaacctctgggccacagac

SEQ ID NO: 31268 - DNA, 202 bp, Homo sapiens
gtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 31269 - DNA, 259 bp, Homo sapiens
tgacagcaggaggcagcacagtccttagcagcatggactctggagcccagttgctgctttagatctcagctcccctttgactagcgtcatgatcttgtgcaaatcacttgaccgctcagtgcctcagtttcctcatctgtatgggataataatattatgagttaatccatgtaaaacacttagaatcttcctcctggactattgaaagtacccattagaggttagctaaaattaatcaacacatttttagacttcacgt

SEQ ID NO: 31270 - DNA, 329 bp, Homo sapiens
  misc_feature 152, 317: n = A,T,C or G
acacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcnggcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggnccagtgttctga

SEQ ID NO: 31271 - DNA, 331 bp, Homo sapiens
cgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacg

SEQ ID NO: 31272 - DNA, 420 bp, Homo sapiens
  misc_feature 180: n = A,T,C or G
atttttcttctatttcaaactttctattattattatatctattatgaggttctatgatcagtgatctttgatgctactgttgaaattgttttgggatgccacaaacctcacccacaggagatggagaatataattgataaatgttgtgtgtgttctcactgctccaccaaacagctggtncccatctctcttcctgtctctgagacatgaaagtattacaattaggccaattaataacctacaatggcctctaagtgttcaagtgaaaggaagaatcatatgtcttttgctttaaatcaaaagctagaaacgattaagcctaatgaagaagacatgtcaaaagccaagatagactgaaagctaggccccttgtgccaaacagccaagttgaatgcaaagaaaagcttcctaaaggaaatt

SEQ ID NO: 31273 - DNA, 331 bp, Homo sapiens
  misc_feature 21, 25, 180: n = A,T,C or G
cttacatcctcagtctagggngacnactaggttgtgctgagctgtggcctaggaattcttttccagacagctcacacaatcctaggggtcacctcattggtttccacttacccaggcatcactgccctgccctgcctgatactcagtgtctgaaaagtattgttaatatatatttctagntaaggttatttcacgtgggagatgaacctgatccttataattccagaagtggaattctaaaacagagcagctttttgcatacgttcaagtacagagaaaaaaataaaacagaaatttgtattaaaaaataaaaaagtaaattaatattaga

SEQ ID NO: 31274 - DNA, 255 bp, Homo sapiens
  misc_feature 176, 178, 188, 215, 231, 247: n = A,T,C or G
gcagtcctactgaggctgcagtgcgcttcgtgggtttcccagataaaaagcataagctgtatggtgtctactgcttcagagcatacaactgaatgtgcccttagagcgcatcagttttaaagtcattaagaacatgtgaaaggtgttttttttttccaatatgaactcatgcaagntnccaaaactgngataacccttttttacttactgtaaanagtcattttcataaanatcaattcattgattngttttttg

SEQ ID NO: 31275 - DNA, 244 bp, Homo sapiens
  misc_feature 4: n = A,T,C or G
aggntgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagctta

SEQ ID NO: 31276 - DNA, 279 bp, Homo sapiens; identical to SEQ ID NO: 28450

SEQ ID NO: 31277 - DNA, 280 bp, Homo sapiens
cctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatt

SEQ ID NO: 31278 - DNA, 164 bp, Homo sapiens
  misc_feature 127: n = A,T,C or G
gagtcctcaacttgtgggatctacactatctccaggtagatagcgctgaaactgaattggaggacacccagcagacatccactgcttggcgtgtggagaaaagcacccacctttgatcacagacatntttctgtattggaagattattgtggtggtgtgagagt

SEQ ID NO: 31279 - DNA, 281 bp, Homo sapiens
  misc_feature 25: n = A,T,C or G
aaggaagaaaaatttttttctaaanttttaagactctacaaggaaccattttaaaaaatgcagaaaggccgggtgcagtggctcatgcctgtaatcccaggactttgggaggtcaaggcgggtggatcacaaggttaagagatcaagaccatcctggccaacatggtgaaaccctgtctctactgaaaataaaaaaattagctgggcatggtggcgcgctcctgtagtcccagctactcgggagtctgaggcaggagaatcgcttgaacccaggatgggga

SEQ ID NO: 31280 - DNA, 181 bp, Homo sapiens
  misc_feature 58: n = A,T,C or G
cgaagcctggttgtcttcttgcctgccctttttcgtaaaatgggggtcccttactgcnttatcaagggaaaggcaagactgggacgtctagtccacaggaagacctgcaccactgtcgccttcacacaggtgaactcggaagacaaaggcgctttggctaagctggtggaagctatcagga

SEQ ID NO: 31281 - DNA, 318 bp, Homo sapiens
  misc_feature 24: n = A,T,C or G
aaaaaaataacatatagcttcaanagcctcttaagcggctgggcacagtggctcacgcctgtaatgccagcactttggaaggccaagactggcagatcacttgaggttaggagtttgagaccagcctggccaacatgacaaaaccccatctctattaaaaatataaaaattagccagacttggtggcaggcacctgtaatcccagctacttgagaggctgtggcaggaggatcacttgagcccaggagccagaggttgcaatgaaccgagatcacaccactgtactccaggctgggcgacacaacgagaccccatctg

SEQ ID NO: 31282 - DNA, 232 bp, Homo sapiens
  misc_feature 23: n = A,T,C or G
catgaaactgcagaaagaagcancgttaggcgttcctgataataattatctgcctggatgacagcagtcctgctttatggtcacagaccccagctttctgccagaacatggctcaggactcctgaaaatcatcccattcgggagcaagtgggtttaatttccttttcatgaaaggaaagattagctttcatgcaaacacttggtccatttggccatttaataagaggactga

SEQ ID NO: 31283 - DNA, 235 bp, Homo sapiens
gaggccgaggcgggtggatcatgaggtcaggagttcgagaccagcctggccaacatggtgaaaccccatctctactaaaaataaaaattagccaggtgtggtggtgggcgcctgtaatcccagctactggggaggctgaggtaggagaatcgcttgaacccaggaggaggaggttgcagcgagccgagatcatgccactgcactccagcatgggggacagagcaagactccatct

SEQ ID NO: 31284 - DNA, 321 bp, Homo sapiens
gaagtattcaataccgctcagtatccttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacgg

SEQ ID NO: 31285 - DNA, 133 bp, Homo sapiens
  misc_feature 133: n = A,T,C or G
cctggcttcttcaagtagagttgtcttttcttgtccttactttatgagatgtcctaactgtagattataccatgattcaagaacagctagacatgcatacacatgaatttgcaatcagttatttagaacgcan

SEQ ID NO: 31286 - DNA, 259 bp, Homo sapiens
caggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgaga

SEQ ID NO: 31287 - DNA, 297 bp, Homo sapiens
tctattttctcctgcctttaaggagtaggaaacaactaagaacagatgatgtctcatgttgcgaatggatccttccttcctttgcttttccctcaagttctttctcatgcaagcgaacacccatattgtgaggggtagcaaatttaaatgagtccttcgcattcgagtatagagatgactgaggagaatgaggtagtttggaaacactagaaaaatctgcctcagtgcttttgatattttaatttataggcaattcttttaagtttcatttttctcaagacaaatgccagactgtgg

SEQ ID NO: 31288 - DNA, 328 bp, Homo sapiens
  misc_feature 8, 9, 32, 33: n = A,T,C or G
aaggaacnngtctttctatctcttgtactacnntgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagca

SEQ ID NO: 31289 - DNA, 241 bp, Homo sapiens
  misc_feature 25, 225, 230: n = A,T,C or G
atgcaactaacctcactccaagatnatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccgcaggggtccggnctacngtcgactgtat

SEQ ID NO: 31290 - DNA, 161 bp, Homo sapiens
  misc_feature 160: n = A,T,C or G
cggaatgcggggtcgagagctgatgggcggcattgggaaaaccatgatgcagagtggcggcacctttggcacattcatggccattgggatgggcatccgatgctaaccatggttgccaactacatccgtcccttcccatcaatcccagcccatgtactanc

SEQ ID NO: 31291 - DNA, 329 bp, Homo sapiens
  misc_feature 6: n = A,T,C or G
gggccntaaagctatcagaagaaatcctgaacttagtggatcacccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaag

SEQ ID NO: 31292 - DNA, 269 bp, Homo sapiens
catcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaaga

SEQ ID NO: 31293 - DNA, 304 bp, Homo sapiens
acatcactcagaactattgattcttagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttagga

SEQ ID NO: 31294 - DNA, 350 bp, Homo sapiens
  misc_feature 24: n = A,T,C or G
tgtggtcgcgtctcggaaaccggncgcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcaga

SEQ ID NO: 31295 - DNA, 162 bp, Homo sapiens
  misc_feature 7, 11, 29: n = A,T,C or G
gtttccnaaanataatgcttccgtttgtnctgcatggatgctcttactaggatttaaacttgctttatgtgacagattctccatttacttaacctcactcaacattcctctcttttactctttctcactcaaaaggatgaactgtctgaaatgatcaaaagg

SEQ ID NO: 31296 - DNA, 370 bp, Homo sapiens
  misc_feature 23: n = A,T,C or G
ctttaaaagaggtaagagcaacntgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctga

SEQ ID NO: 31297 - DNA, 155 bp, Homo sapiens
tcccggcatgccttcattttgctatggggggcgggcaggggggatggaaaataagtagacacaaaaaagcagtggctaagatggtatagggactgtcataccagtgaagaataaaagggtgaagaataaaagggatatgatgacaaggttgatcc

SEQ ID NO: 31298 - DNA, 169 bp, Homo sapiens
  misc_feature 169: n = A,T,C or G
aacaaatagattgacacaatttttaagaatcaaacagaaattctggaggtgaaaaatgcagttgacaccctgaagaatgcagcagcctcttaacgggagaattgatcaaacagaagaaagaattagtgagcttgaagaaggactgtttgaaaacatatttaggaggcgn

SEQ ID NO: 31299 - DNA, 205 bp, Homo sapiens
gtacttaaaggaataataaatgcctaatatgaggtcagtggacgccattttctgttataatcatttttgttatctaatttggggaaactattcatctgtcatatactattgatcctttggcacttaaataaatgtgaaatcctccaggaattttcctgtgattctccttgtaagaattaaatgctctctaatatgatatcccttt

SEQ ID NO: 31300 - DNA, 337 bp, Homo sapiens
gagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctgga

SEQ ID NO: 31301 - DNA, 282 bp, Homo sapiens
aggggaagaggcccgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactat

SEQ ID NO: 31302 - DNA, 327 bp, Homo sapiens
gtccaaaaacaatccattgatacacttggtgacattaattgagaaaaaaacaatatggtctggccatggaggcatggtatccgtaacatcccccaaaggagctaaagaagaaatccacaatttaccatgagcatttctcgtctgaagattgccaagcgattcctccaggacattcctcaagatcaatttctgttcatccaccttgtcctgggagggacatcaatgggtttccatgtcctttggcttctggttgagttcactcagtggagaaccctggcaagaggcaggaaaaggggaggaaggtgaaaaccatccatttcttggaga

SEQ ID NO: 31303 - DNA, 274 bp, Homo sapiens
  misc_feature 2, 23, 28, 29, 48, 52, 56, 71, 96, 113, 126, 175: n = A,T,C or G
tngccttgtgtaagaaaccctangaccnnggaagaaccctggggattntttnttantgtgccgcactaaanttactctgaggctttagcaagtggnaattacgattgcccatngtgtaagaacaanttgatttcctatccacctgattatgttctctggttagtttagccatttngaacttaagatcatatgaccttagtgcttttggctaaacatacagaatactacttgtatgcagaagagaattagttgattacatgtttcaaccttttag

SEQ ID NO: 31304 - DNA, 291 bp, Homo sapiens
  misc_feature 17: n = A,T,C or G
gttctcactattctggnggctggacctccaagatcaaggcattggcagatttggttcctcctaagacttctagagagaaggtaaccacctgcaagctaaggaaagaagtctgtgtcctcacatggccctttctctatacatgcacccctggtattccttccgcttcttataaggacgccagtcctattgaattaagttcctgttcttatgactttatttacctttaattacctttttaaagatcctagctccaaatatagccacattgggggttagggcttcaatatatga

SEQ ID NO: 31305 - DNA, 388 bp, Homo sapiens
cgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaaga

SEQ ID NO: 31306 - DNA, 179 bp, Homo sapiens
  misc_feature 32, 146, 157: n = A,T,C or G
agttactttgcaagtaaggtagaagatcaagnacactttttcaaaaatggcaatggtaccaggaattcctcaagcaggcctggtttattgaaaatggaagagcaggaatatgttcaaactgtgaagtcattccaaaggtggtcccnggatcagcggngagccccttatcctaccttcat

SEQ ID NO: 31307 - DNA, 299 bp, Homo sapiens
  misc_feature 4, 26: n = A,T,C or G
tggncgaactgaaacatcatctcttncaaaggtgagattaaacacaatagaattatttacagaacttccatcttataagccactttttcattaaatttggataataagtggtgctttgctacctgatttaaactagttttatttaggctatgaatcaacctctttgttccaaaacactggaataggggaatgttttgcatttccccttccccacgagagtttgttttcctctaagtcacattaagatgctgttctcaagccagtttcgtttcacctagtgcctagtttttggagtggga

SEQ ID NO: 31308 - DNA, 350 bp, Homo sapiens
  misc_feature 7, 8, 34, 58: n = A,T,C or G
aagaatnnctgggaatttttttcctgaagttttntttattccacatctacatcagtgnaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactg

SEQ ID NO: 31309 - DNA, 360 bp, Homo sapiens
  misc_feature 2, 25, 179, 180, 275: n = A,T,C or G
gngttggggacatagcagagatccngatgacttcaggtcttgccttcatggacctgccagcctagttggggagaaggactgggcccaataccagaagctgatccaaagtggtcagaactggggaaggagacctgtgagctgaaagcaggtaaaggaagtatccagacagaggcactggnnaaagacctggagctgggaagggtctagggaccagggacaggttgtactgtaattctggaaacctgtgaggctcaaagaaagggcagagagctcangtgggaaatagaaaaggcacctgaacagtccagggatggctttcgactacttgaaacagccttgggagtttcagaagctattgga

SEQ ID NO: 31310 - DNA, 152 bp, Homo sapiens
  misc_feature 3, 7, 39, 74, 96, 104, 115: n = A,T,C or G
gcngaanctgtcaagtccaactacagccccacacatcgngaaagagtagccggcttcagtgcctgccttggggngaggaagacacctctgccccantggattancaagtgtggcnggcttaacatgtccaggttctccccaataacattgtc

SEQ ID NO: 31311 - DNA, 128 bp, Homo sapiens
caaagaaggaacagctctttggacacctaggaaaaaaccttgtagagagagtaaaaaatttaacacccatagtaggcctaaaagcagccaccaattaagaaagcgttcaagctcaacacccactaccg

SEQ ID NO: 31312 - DNA, 256 bp, Homo sapiens
  misc_feature 4, 26, 178: n = A,T,C or G
cagnccactctgtctttaaaacatcngtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgntaatactgtttttcttctatctgtagttagtacaggatgaatttaaatgtgtttttcctgagagacaaggaagacttg

SEQ ID NO: 31313 - DNA, 260 bp, Homo sapiens
  misc_feature 259: n = A,T,C or G
tgacttgaagaaccctgactttgcttctgcaaaggcacctgcatgtgtctgtgttcgtgtaggcataatgtgaggaggtggggagagcaccccacccccatgtccaccatgaccctcttcccacgctgacctgtgctccctctccaatcatctttcctgttccagagaggtggggctgaggtgtctccatctctgtctcaacttcatggtgcactgagctgtaacttcttccttccctattaaaattagaacctgagtnt

SEQ ID NO: 31314 - DNA, 291 bp, Homo sapiens
  misc_feature 23, 181, 244: n = A,T,C or G
gaagatattttgcatatatattncaataacaaaattgagattacattgtgcatagatttttatggcccttttctcataaacagttttctatttttttattagcttatcttcaaaaacaagattttaatggcatcaaggttttctatcatggataaatcataatttattccaacagtagatngtgggacaattaagttatttctgatttttttctgtgataatttatcatggaatattcatatgntagaagtctttttaagagcttgattatttccctagaaataatctagg

SEQ ID NO: 31315 - DNA, 317 bp, Homo sapiens
  misc_feature 25: n = A,T,C or G
tataccaatagaagggcaatgcttntagattaaaatgaaggtgacttaaacagcttaaagtttagtttaaaagttgtaggtgattaaaataatttgagggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaaga

SEQ ID NO: 31316 - DNA, 193 bp, Homo sapiens
gatttcacttggtgatctaaatttgtttatttaagctgcaagaaagttacattaatttggaatgtgtcatcacttggacccagtatatcagatttttattgagtaaaatgttaaaaataataagtgtaactcagattctggatgttcgagtttacaatacattgcctgtaataaaagctgattctgaagtgga

SEQ ID NO: 31317 - DNA, 347 bp, Homo sapiens
  misc_feature 24, 26: n = A,T,C or G
tgtataaataattgcaaatatagncntgccgagggcttggcgagaagggtggcagacgtctacagagagtagaattgtctgcaggatctgtggcatttattgactcagggatctttgggtgtttgaatgcaaaacccagagagctgacctgtatttctcctggtggaagatgagcctcacaattcagctaactgcttaggaggaaattaggcttcctatgaattaagtatacgttattgtaatcctatatctgaagctcaaattcattacttactgttatgtagctgtgtttaattccactacctttacctatgagtgacaatagcaagggatattgtcaaataaga

SEQ ID NO: 31318 - DNA, 209 bp, Homo sapiens
accttcgggtcaaggcagaggcacgaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaag

SEQ ID NO: 31319 - DNA, 310 bp, Homo sapiens
  misc_feature 18, 25: n = A,T,C or G
gacaaaaatttacattgnggctccnagagttcaataatataacaattatatgaaatttcatatttttagaaatgatcaaactgccagttctttagtaatctctcactgatgtgtcatctctactgcgatgtgtcatctctactgctttccagagctttaaaataattaaaagccaattcttacatttgtgtaatggaaaagctggctactataaaatttacctatgtgttatctgaaatttgttactgtataaatttcagttctatcctatagtacttaggaaaatgaatgtgattcttgccttttccga

SEQ ID NO: 31320 - DNA, 311 bp, Homo sapiens
gttcaacatttacctggtttccatcccggaacttctcttcatgctctgtatctttggataccttatatttatgattttctacaagtggctggttttttcagcagaaacctccagagttgctcccagcattctgattgaatttattaacatgtttttattcccagccagtaaaacaagtggcctttacacagggcaggagtatgtccagagagtgctgctggttgtcacagcattgtctgtccctgtcctcttcttgggaaagccactgtttttgttgtggcttcacaatgggcgtagttgcttcggggtga

SEQ ID NO: 31321 - DNA, 142 bp, Homo sapiens
attactcagttctgtaaagcaaaccaaaaccaaaacaaatctaacctatggagggagaaaaattttatttgacatgctttccatcccaacaaaaacagtctctagccactaaacccaaaatacgtcatcttatagtcaaagc

SEQ ID NO: 31322 - DNA, 399 bp, Homo sapiens
  misc_feature 24, 314: n = A,T,C or G
agaaacttgtgcttcaccgaagtnttaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgnggaatagctcagaatgtcagttctgttttaagtaacagaattgataactgagcaaggaaacgtaatttggattataaaattcttg

SEQ ID NO: 31323 - DNA, 326 bp, Homo sapiens
  misc_feature 19, 24: n = A,T,C or G
ctcgtgtaacggcggcggngtccngcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaaga

SEQ ID NO: 31324 - DNA, 170 bp, Homo sapiens
  misc_feature 23: n = A,T,C or G
ctttttagaagcaaacaattttnaatatattttgttcttcaaataaatagtgtttaaacattgaatgtgttttgtgaacaatatcccactttgcaaactttaactacacatgcttggaattaagttttagctgttttcattgctcaataataaagcctgaattctgatct

SEQ ID NO: 31325 - DNA, 163 bp, Homo sapiens
  misc_feature 25: n = A,T,C or G
aaccctctaaatccccttgtaaatntaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 31326 - DNA, 353 bp, Homo sapiens
  misc_feature 20, 23: n = A,T,C or G
tgagggggcaggcggagctngangaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgactt

SEQ ID NO: 31327 - DNA, 282 bp, Homo sapiens
gcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatgggga

SEQ ID NO: 31328 - DNA, 193 bp, Homo sapiens
  misc_feature 25: n = A,T,C or G
cttgacatcctctaagatgtagacnttacccttggttgaatatatgtttttctttgattagagtggggtaaatgaagggtgatgatactcacactgaatcttgaatttgacacatttcttccaatgaaaatgggctgcaaggaacccagttgtatctggcaccgttttttagtttttttttttctctgacaca

SEQ ID NO: 31329 - DNA, 249 bp, Homo sapiens
  misc_feature 22: n = A,T,C or G
ctcccgggggacttggttttcntccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaaga

SEQ ID NO: 31330 - DNA, 387 bp, Homo sapiens
tggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataaga

SEQ ID NO: 31331 - DNA, 211 bp, Homo sapiens; identical to SEQ ID NO: 29051

SEQ ID NO: 31332 - DNA, 347 bp, Homo sapiens
  misc_feature 26: n = A,T,C or G
taggatattctatattaaacactaanttaaatgtaataaaggccaaaggcctctgtatgaaattggatttaaactttcttattttagggaataaaacattattgatcaaacagtatctgttctaacctaaaattataggtagggcaggctaagtgaacagcattgagtattttctgaatccctcatgataatttatagccacatactgcttcctttgacttcaggaatgatcagttttcataatggccactgggcctgcttagattgcagtattcattatctgcatctaatttggtagtttccacaatcgtatttgatgaaagaaacttcagtccccattattacct

SEQ ID NO: 31333 - DNA, 263 bp, Homo sapiens
tccctttgtgacttgaagaaccctgactttgtttctgcaaaggcacctgcatgtgtctgtgttcgtgtaggcataatgtgaggaggtggggaggccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccct

SEQ ID NO: 31334 - DNA, 379 bp, Homo sapiens
tggagattgcagtgagccagatcacttcactgtattccagcctgggcaacagatccaaccctgtcttaaaaaaaataataaaaaataaaaaaagatatgtagtttgatatacttgaaatttcttcactagatgagatactgaaaatgattataaagtgtcgaagggaaatagtatctgatttgacagtgtttcataaggatgaggccttttactttttccagtgttttaataaccctaaatttcatgaaagaatatgattgtatattcattgatctacattctctgacctttggctgtgctgacaaacacaaaatgttggcaccaagagaaacttgagagaaaggagcctagatacagttgaaggcactaaagccaaga

SEQ ID NO: 31335 - DNA, 128 bp, Homo sapiens
  misc_feature 127: n = A,T,C or G
gcgtcgatgaagaacgcagctagctgcgagaattaatgtgaattgcaggacacattgatcatcgacacttcgaacgcacttgcggccccgggttcctcccggggctacgcctgtctgagcgtcgctng

SEQ ID NO: 31336 - DNA, 315 bp, Homo sapiens
  misc_feature 21, 253: n = A,T,C or G
tgatgtcacctaaagtttttngaacaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgngagcagctcctccacctggagctccgaagcatcttctcaggccaaagcggcattacccgtga

SEQ ID NO: 31337 - DNA, 353 bp, Homo sapiens
  misc_feature 25: n = A,T,C or G
catcttcattgtcttacctctgaangaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcgcaatatgcataaaacatttttcaaaattgaaatttttccctgggcattaaaaacctttactattggctacaaatttattgtacctgatgaaaacatattttctgga

SEQ ID NO: 31338 - DNA, 289 bp, Homo sapiens
  misc_feature 18, 25, 27, 34, 44, 47, 48, 57: n = A,T,C or G
ctccgcttggggccccgnactttgngnacaggantgtcaggtgnctnncatagaggnctcatgagtttattcatccaacaaacacttatgaaataccgactacaagccaaacatcatatgtttagatgggtggagtcaagaggcactttttaagcagttagggaaggaaaatctcaggcaagggtacggtaagttgtatgtgtagaactaaggaaaacatcacagacatagtctgatggctgggaggaggcctcagattggcagtagaaaaactgaaagtaaaacagga

SEQ ID NO: 31339 - DNA, 292 bp, Homo sapiens
  misc_feature 9, 23, 177: n = A,T,C or G
ccttttggngttttatgaagccntgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctntgtagatagaaacaagctagctttaccaaagagaaatagtgtcatagaagaacaaaacttcatatagaaagttctaggcaagtatttgatggtttccttaaggatgtgagctttg

SEQ ID NO: 31340 - DNA, 292 bp, Homo sapiens
  misc_feature 20, 21: n = A,T,C or G
gcctgctaaacttggacatnnattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaat

SEQ ID NO: 31341 - DNA, 265 bp, Homo sapiens
gcaccgggaggagtgagatgtggctgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctgaaaga

SEQ ID NO: 31342 - DNA, 218 bp, Homo sapiens
atccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaat

SEQ ID NO: 31343 - DNA, 140 bp, Homo sapiens
  misc_feature 21: n = A,T,C or G
agagtccgtgcctttccctgngtgaattttgtatctagcctaaagtttccctaggctttcttgtctcagcaactttcccatcttgtctctcttggatgatgtttgccgtcagcattcaccaaataaacttgctctctggg

SEQ ID NO: 31344 - DNA, 114 bp, Homo sapiens
  misc_feature 22: n = A,T,C or G
gcgcttcttagaagaggagtgngaggaaggcggggggcgcagcaacgcatcgtgtggccctcccctcccacctccctgtgtataaatatttacatgtgatgtctggtctgaatg

SEQ ID NO: 31345 - DNA, 344 bp, Homo sapiens
  misc_feature 25: n = A,T,C or G
tcctgaaacccggcagaaaggcccnattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacaga

SEQ ID NO: 31346 - DNA, 261 bp, Homo sapiens
  misc_feature 24: n = A,T,C or G
tatatctccaaaagattgatccgncagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcaggaaatg

SEQ ID NO: 31347 - DNA, 257 bp, Homo sapiens
  misc_feature 25: n = A,T,C or G
tgctcattcttgttttattgtactntctagtgcagtagacaatacctaatagccagtggcaggtagaagtggtgaagtcagaccttcttgccttattcgcagtcttaagaaggtagttagtctttcatcaggtgtaattgtcagttctaggtgcctttttatcaatctaaggaagttcccatctattttagtttgctgagagtttttattatgaaaagaatgttaatatatgttaattttttttctctgtctacttg

SEQ ID NO: 31348 - DNA, 269 bp, Homo sapiens
  misc_feature 3, 15: n = A,T,C or G
gcntgataaaggagnaaataagacatatccctgcagcaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctg

SEQ ID NO: 31349 - DNA, 315 bp, Homo sapiens
  misc_feature 25, 27: n = A,T,C or G
gatttagttttcatatcgtatacancngctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacgggggaagagataagatactgcgaataggccctcaaacttaaaaaagaaaaaactttgccagttttaaggacatattttgattctttcagtattcttaacacctttttaaacaaagttcttgatagta

SEQ ID NO: 31350 - DNA, 316 bp, Homo sapiens
  misc_feature 316: n = A,T,C or G
tagtgccacggttagaaaccctgaattaaatacatcattgtttgtatagtcaaaatagcagttaacttaaaacttgagaaacattttgttgattccagtatattgaacagtatcctgaataacactcttaaactagaagacaaacgtgattactagttaataaaaatgtaagaaatgagaaagttaagtaagataatccaggctgggtgcggtggctcacacctgtaatcccagcactttggaaggccaaggtgggcgaatcatgatgtcaggagttcgagaccagcctggccaacatggtgaaaccctgtctctn

SEQ ID NO: 31351 - DNA, 314 bp, Homo sapiens
cataataaggttttctaaagagtttggttaggttgaaagtccagttctgctcctggaccatatgaaaaggtcagaatctctgatagcctgaaatctcaaacatctccattacttatactcaatcccactgcccctaatcattctttgcctcattcatcaaactagtatttattgagtacatattatgagccaaacactgttctaggttcagtagatacagcacagacaaaggcacacagctgtttgctgtcatgggtctttaaattatatcactcagctatgctcagttatgctgagttggatatttgcaacat

SEQ ID NO: 31352 - DNA, 356 bp, Homo sapiens
atccaatttcaatggccgtttttactatctgatccccccaccaaactgacctatgatgaagcggtgcaagcttgtctcaatgatggtgctcagattgcaaaagtgggccagatatttgctgcctggaaaattctcggatatgaccgctgtgatgcgggctggttggcggatggcagcgtccgctaccccatctctaggccaagaaggcgctgcagtcctactgaggctgcagtgcgcttcgtgggtttcccagataaaaagcataagctgtatggtgtctactgcttcagagcatacaactgaatgtgcccttagagcgcatcagttttaaagtcattaagaacatgtgaaaggtg

SEQ ID NO: 31353 - DNA, 465 bp, Homo sapiens
atggccgggggcagggctgaggcttcttaatgtttacagttccggtgtaaatccagttaataataagaattagcatctgacttttgtgtatatgctgccaatgaaaggttcatttaaaaataagtcataaggaaaatattttccaaattaacacaagtgggatctattggcttttgttcaggaagaaaaagtaacagcgtattgtaaacttcgattttcattgttgtattcgagtgtataattacactgctattaatacttgttttccttttttccacatgttctaagcaccacagtttatttattcataacactgttaatgcacattttggttgtttccagtttggggctttaacaaacagtgctgctgtgaacattcctatacctgtcttttgatgaatatacacagttctgtgtaactaaaaggaaagaaaagtagaattattggatcgctggatatgcctg

SEQ ID NO: 31354 - DNA, 313 bp, Homo sapiens
gatcctgagtatccttttatctgcttttcccagaaaagttaaaaaggaaaagataaatttagcctgaaaggttttgcgttttagcacttgcacatttagagtgaaaatttaatgtaataatatgatgaagtaataaaaatctatattaaatatatgtatatttatttaaacatatatagattaaaatataaaatgcttcctgataataatataatgaaataaaacaataaaacttcaatttttaaaaataattgaataatacgtatttttagggttctttttagttacatgtatctgtgggggataatgattg

SEQ ID NO: 31355 - DNA, 358 bp, Homo sapiens
  misc_feature 34: n = A,T,C or G
ggagccggaggtggcaattcaccgaattcgaatnccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagtt

SEQ ID NO: 31356 - DNA, 483 bp, Homo sapiens
  misc_feature 12, 13: n = A,T,C or G
tatggccgggannaaaatctcttatagaattaaaagactggaggaaaggcaaacatgaaagagatgtgtagcagatcaacaatgtcatcaaaagccctttatatacaggtacctttttcggccacatatttgtattgtaacaagaactcaggcaaagttttatccatagttaagaagaactcttgggatctataagtttggggcactcaatactggtttgagcaaatttgggttggagaagaaaggacaggatcaagcctacttcagtaaactgcacaagaatcattgccaggggcaaaaaggttgttttgtggtagaaccctacttttgaaaagtagcctgcattaaggctaagaattgagacaaagctatgttaagccaaatagaggagccaatattggctcattgtatctatttacttggccgtgattaccatgctagctttttgtcctcatgcttgtggcctctggttgcaaattgact

SEQ ID NO: 31357 - DNA, 464 bp, Homo sapiens
  misc_feature 9: n = A,T,C or G
acaacaganggcaaatatgaattgctccttggaattggtaagcaacctagagaaaaatcagcagtcagtttacattaaaagaaattcaaatgaccctcaagcatatgaaaatatgttcaaatatacgtataaaagtcatgcagattaaaactgtgctaaaatattttttctcacctattgcctcattgtgttggtgaggctgtggataaataagttttttcatactctgctcctgggatagttatctaaattgcaaatgcatataccctttgaccaggcaattccatttctggtaatttatcctaaaaataagcctgcacaagtgaaaaatgatatatatagaaggtttttttatggcagcaatatttacaaaaacaaggttggaagcaacccaaatgcccatcaaaaggaatctggtttaaaaaatatggtacatttatacaatggaaaactagggaactggg

SEQ ID NO: 31358 - DNA, 340 bp, Homo sapiens
  misc_feature 7, 8, 52: n = A,T,C or G
ctcggcnnttatggcccgggcctgttgatgttaacctgagctacctagagtnattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatgcaggctatgtaaaatttttactaatgtcattattttgaaaaaataaatttaaaaatacattcaaaatt

SEQ ID NO: 31359 - DNA, 500 bp, Homo sapiens
  misc_feature 8, 9: n = A,T,C or G
aggagganntcaatattttgaatctcaatttgatgtctagattttatgcaatcttaatcaaaattccagcacatgtttttagtagatattgacaagcttattcaacaatgtgtatgaaaggcaaagaaacttgaaaaatcaaaacgatctgaaacaaacaaagctggaggactcactgcctaattttaagatttttgcaataaagcacagtaatgaagattgtgttatattgattaaattatggacacatatatcaaaggaatagaataaagattccagaaatagacccacgtaaatactgtcaactgattttgacaaaagtgtaaagccaattaaatgtcgactttgtttttgttatcttttaaacaaatggttctagattttttttaaaagccccttggcgtgtaattcaaaatagatcatagatcttcaatgtaaaactgtaaaacttctagaggaaaacatagtagaaaatctgtgtaatttaatttcggcaatga

SEQ ID NO: 31360 - DNA, 396 bp, Homo sapiens
  misc_feature 8, 9: n = A,T,C or G
tgggaaannaatcttttgtaaatgcaaagctgttttttgtatattactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcactttgtacacttgacagctgaaaaaaaacaacatgggagtaataatgggtt

SEQ ID NO: 31361 - DNA, 134 bp, Homo sapiens
gggaaagtgaagacatatgagtggtaagaaacaatgagtaacaggatcaatattttgtagaccttaatggggtcatgtcattgttagacttggggtactatttaggatgaactagaatggtaatatgcagtagg

SEQ ID NO: 31362 - DNA, 333 bp, Homo sapiens
  misc_feature 5, 6: n = A,T,C or G
tcagnntatattataaacacctctatgcacacaaactagaaaagtcagaagaaatggataaattcctggacacatacaccctcccaagacagaaccaggaagaaactgaatccttgaacagaccaacaatgagctccgaaactgaaacagtaataaatagcctaccaactaaaaaataggccaggagcagatgaattcacagccaaattctatcagatgtacaaagaagagctagtaccattcctactgaaactattccaaaaaactgaggaggagggactcctccctaactcattctatgaggccagcatcatcttgataccaaaacctgac

SEQ ID NO: 31363 - DNA, 498 bp, Homo sapiens
  misc_feature 399: n = A,T,C or G
atccggtgttagaagccgcctggtaggcccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgntttgctgtcaaccccagcatccttcccactgctttcatgggcacggcaatgatctttacctgcttcaccctcagtgcactctatgccaggcgccgtagc

SEQ ID NO: 31364 - DNA, 478 bp, Homo sapiens
  misc_feature 8, 13: n = A,T,C or G
gagcaganaaganggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaat

SEQ ID NO: 31365 - DNA, 471 bp, Homo sapiens
  misc_feature 4: n = A,T,C or G
gganttggtgaggagctggcttaccagttgtctaaactaggaagttcctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggcct

SEQ ID NO: 31366 - DNA, 431 bp, Homo sapiens
  misc_feature 3: n = A,T,C or G
tcngggtaccctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtgatgaaatgttcaagtattacagcaatattcaaagaaagaaccacagatgtgttaaccatttaagcagatcatctgccaaacattatattactaataaaacttaaccaaca

SEQ ID NO: 31367 - DNA, 500 bp, Homo sapiens
  misc_feature 8, 10, 29, 52: n = A,T,C or G
tcccgggnantcggttcttaggccggggncttgtataatgtttactaaaagnagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtatt

SEQ ID NO: 31368 - DNA, 479 bp, Homo sapiens
  misc_feature 3, 10, 465: n = A,T,C or G
ctntaaagantttcccttatgaatgtagatgcagaagttccttgtacaatgctagctaactgaatccaataatatgtattaaacaacaattcttaaacaagtgggattgctcttaggaatgcaaagatgatccaatatcagaaactttatccatgtaattcacattaagaggctacaggagaaaaaccatatggttccctcaatagaggcagaaaaaaatgatgtgataaagtttaacgcctatgtgtgattttggggtagtggagtacaccacttagcaagccaggactagagaggaacttcttcaacttgatacaagttataaaccaaaacttaacttttcagtaaacttgatagagaaattaaaagtgtatcattctctttaagataaggagtaggccaaggatgtcatcctggccataccctaatacaagaaaaagaaatggggatgtgaggatcaggtanggaagtgataaaac

SEQ ID NO: 31369 - DNA, 248 bp, Homo sapiens
  misc_feature 13, 216: n = A,T,C or G
tatggccggggantttgtcttattttgaattgtacttaccagtatttactttataaaaaaaatttgcagttatataggataggtacagttattttggaaataagaggaattgtttctttatataaaaagcgtggaacaagtgtagatttgaattgaatcttcaatgggtggatgctgactggctgtgcttatttaatataccttccaatcagactnttagcagcctaggcaacatacccagaccccat

SEQ ID NO: 31370 - DNA, 433 bp, Homo sapiens
  misc_feature 9, 70, 77, 119, 169, 223, 241, 242, 288, 300, 342, 394: n = A,T,C or G
tgtaaatanttgtgtgtgtgtgtgtgtgtatatatatatatatgtacagttatctaagttaatttaaagntgtgtgngcctttttatttttgtttttaatgcttcgatatttcaatgtnagcctcaatttctgaacaccataggtagaatgtaaagcttgtctgatcgntcaaagcatgaaatggatacttatatggaaattctgctcagatagaatgacagnccgtcaaaacagattgtnngcaaaggggaggcatcagtgtccttggcaggctgatttctaggtangaaatgtggtancctcacttttaatgaacaaatggcctttattaaaaactgagngactctatatagctgatcagttttttcacctggaagcatttgtttctacttngatatgaccgtttttcggacagtttatttgttgagagtg

SEQ ID NO: 31371 - DNA, 220 bp, Homo sapiens
  misc_feature 126, 172, 174, 179: n = A,T,C or G
tatggccgggaggattttatatttttgtccattgtggtcttgcttatcttaagtttgatttgtaaatattttatgtttcttttagtctattgtaaattgtgtatttttaatttcattttttttttngttaatagcatataaaacacaccttgtcttttaactggagcatttngnccatngggtatttaatgtaattaaatctaccatcttattttatgcc

SEQ ID NO: 31372 - DNA, 468 bp, Homo sapiens
catttcactcttcgtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctgaggcactggtggaataaaaaacctgtatattttactttgttgcagatagtcttgccgcatcttggcaagttgca

SEQ ID NO: 31373 - DNA, 251 bp, Homo sapiens
  misc_feature 39: n = A,T,C or G
gaagctacagcctggacttaccaccactaaactgcgagnagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagc

SEQ ID NO: 31374 - DNA, 172 bp, Homo sapiens
gcaaatacttaaatctaagagctgaaaccatgaaaattttagaagataacatcagaaaagcccttctagatattagcttaaggagagactccatggccaagaaccgaaaagcaaatgtaacaaaaacaaagataaatagatgagacttaattaaactaaaaaaattctacac

SEQ ID NO: 31375 - DNA, 471 bp, Homo sapiens
  misc_feature 10: n = A,T,C or G
agcctaaaangaagaaatcctctctgctgcagacaaaatggatgtgattgcaggtctgtatattaaatgaaataagccaggcacagaatgtcaaatatttcatgtcctcacttctacgtaggaagaaaaaaggaaaccttgaccaggcgtggtggctcagacctgtaatcccagcactctgggaggccgagtcgcacggatcaattgagtccaggggttcgagacccgcttggccaacatggtgaaaccccgtctctacggaaaaaacaaacaattagccgggcgtggtgacgcgtgcctctggtctcagctgcttggagggctgaggcccaagaagcgcttgaactcgggagacggagcttacagtgagcccggattgtgcctgtgtactccaacctgggcaacataaagagactccatcacacacctacacacaaaaggaatctcaggaaggtggaaagtataaaaggt

SEQ ID NO: 31376 - DNA, 289 bp, Homo sapiens
ggtgaaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagtc

SEQ ID NO: 31377 - DNA, 121 bp, Homo sapiens
cgcggtggctcacacctgtaatcccagcactttgggaggccaaggtgggcggatcacgaggtcaggagatcgagaccatcctggctaacacggtgaaaccccgtctctactaaaaaatacc

SEQ ID NO: 31378 - DNA, 150 bp, Homo sapiens
ctgactaccttgcttacagattcatggtttgataaatttgttgtattcaaaaacttgaaatgcaggacgccattaagtgtctgtttatatttttggaatatttgtattacttacaattaattaataaaagtgggtttaaaaaacctttcc

SEQ ID NO: 31379 - DNA, 465 bp, Homo sapiens
gttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgttt

SEQ ID NO: 31380 - DNA, 142 bp, Homo sapiens
tacctgtgatgtgttttacccagcacctccggacactcaccttcaggaccttaataaaattattcacttggtaagtgttcaagtctttctgatcaccccaagtagcatgactgatctgcaatttaaaattcctgtgatctgt

SEQ ID NO: 31381 - DNA, 131 bp, Homo sapiens
attctcatttgtggttatacatagtaaaattattttaataatttgtgacttactggatattaggaaattggacacaaacttgtctttaaggattaagggtggagatattctcagtgttaacagcaaagata

SEQ ID NO: 31382 - DNA, 367 bp, Homo sapiens
  misc_feature 4: n = A,T,C or G
agangtaaaaataaaaaatggtatgtgctgttgccattttgcataatgtatgtacacttgtacatttatatataaatgcagagagacgcatatccacacactcagacacacaatgagaacaccatgctgaataagtgttatgtcttcatgtacggaatgtaggtttagtgccaatgccaaggagcaaacaggtgggaagacaaggggctgtgcataaggagccatggctaagccctggggtctaaaaggctgaaaccagcaagcctggagaccagtggatacagtctgtgtgtctgtgtgacgaagtcacctctgtcctccagaaggttgggtttcctgggccccatgcatatgcaggttttttttg

SEQ ID NO: 31383 - DNA, 469 bp, Homo sapiens
  misc_feature 11: n = A,T,C or G
aagaaataatnttttatcagacacactgaaatggatcaggataaacaagaaagtaactcggtggagccctgtgtactgccaggtgggagaggagttctcttgtgtggttatgggaaaaggtgtattttctttccattgatgcttcatcccacgtgtttagtgcactggtttctgaaaccgaagacaagaggcagcccatttccactgaatagcctggccatcaataagtttccagaaggactggggagaaacaaagaatggcccccaatgctggggtctggggttattttgagttaaagggactcggagctactgaatgtcttccacattcaagtcctagaactctttccttgagatattccactttacatttccaaagacagaggaaatatggtagagccaatttcctaaaagttttcgtagaatttcataagcacagcattgatccatgatccgggtagtctgagag

SEQ ID NO: 31384 - DNA, 303 bp, Homo sapiens
  misc_feature 299: n = A,T,C or G
ggctgtaggcccgggtggttgctgccgaaatgggcaagttcatgaaacctgggaaggtggtgcttgtcctggctggacgctactccggacgcaaagctgtcatcgtgaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattatnaaga

SEQ ID NO: 31385 - DNA, 190 bp, Homo sapiens
atcacatatattcatctcaaatttgaaatctggagtgtttgtcttgaaattaaattgtggtattgtaagctgtcagtggaatgatctgtgctggaacctgatgcggtctagtttacacggtattgaatcatgtaagtatctcatctttcctctttgaattcagtatgacttcacataggtgagggttagc

SEQ ID NO: 31386 - DNA, 470 bp, Homo sapiens
  misc_feature 24: n = A,T,C or G
gaagataaaatatgaagacttagnaagagtagcatgaggaaggaaaagataaaaggtttctaaaacatgacggaggttgagatgaagcttcttcatggagcaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaaga

SEQ ID NO: 31387 - DNA, 152 bp, Homo sapiens
  misc_feature 15: n = A,T,C or G
caccaagtaaccggnacccagcctccaggcccccaactccgcccagcctctccccgctctggatcctgcactctaacactcgactctgctgctcatgggaagaacagaattgctcctgcatgcaactaattcaataaaactgtcttgtgagc

SEQ ID NO: 31388 - DNA, 401 bp, Homo sapiens
  misc_feature 5, 10, 30, 32, 90: n = A,T,C or G
tccgntccgncttctctcctacctaagtgngngccgctcacccgatggaagtattcgatggacatggacatgagccccctgaggccccanaactatcttttcggttgtgaactaaaggccgacaaagattatcactttaaggtggataatgatgaaaatgagcaccagttaactttaagaacggtcagtttaggggctggtgcaaaggatgagttgcacattgttgaagcagaggcaatgaattaccgaaggcagtccaattaaagtaacactggcaactttgaaaatgtctgtacagccaacggtttcccttgggggctttgaaataacaccaccagtggtcttaaggttgaagtgtgggttcagggccagtgcatattagtggacagcacttagtagct

SEQ ID NO: 31389 - DNA, 316 bp, Homo sapiens
  misc_feature 3, 10, 252, 295: n = A,T,C or G
ctnacccctntaccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtnaatttaactgttagtccaaagaggaacagctctttggacactnggaaaaaaccttgtgggagag

SEQ ID NO: 31390 - DNA, 442 bp, Homo sapiens
ggcaccctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagaggagtttttaaagaagaaaatcaaaagggagataaaaaattaaggtgtgactctgctgaccttcggcatgacattg

SEQ ID NO: 31391 - DNA, 487 bp, Homo sapiens
gcattatggccgggaatatagcaaggactaaccccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctataga

SEQ ID NO: 31392 - DNA, 473 bp, Homo sapiens
  misc_feature 15: n = A,T,C or G
gcgggccctgagccnggagatcacccgcgacttcaacctcctgcaggtctcggagccctcggagccatgtgtgagatacctgcccaggctgtacctggacatacacaattactgtgtgctggacaagctgcgggactttgtggcctcgcccccgtgttggaaagtggcccaggtagattccttgaaggacaaagcacggaagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactgaagttatgtcagctacccagacttaatgggccagagccatgaccctcacaggtcttgtgttaagttgtatctgaaactgttatgtatctctctaccttctggaaaacagggctggtat

SEQ ID NO: 31393 - DNA, 193 bp, Homo sapiens
gagaatcagcagctgtgtttctacagtgataatctgcgtatgcatgttcgtgatgttccaatcaccaaaaaggctattgattttaggattcctgagtacctacaaaagctacttaaacatccaggataaaatcagctccacccaagaatacaagataagagttcaaatattcccttggccatttttttttttt

SEQ ID NO: 31394 - DNA, 470 bp, Homo sapiens
  misc_feature 25: n = A,T,C or G
atgagcaagatcaacattgccaagnaggagagccaaccagcaggaagcagaaatgttttattttacagtaagtggcatcctgggcccagaaccacactgtcggccaagccactggcagtgacttttcaggagcaacccaagctactgagaaccagagaaaccacatgggtcaattggatctaagactccatcaccatgcttttaaaattaagttgcctggcttggttttctgaaatgcagaaagtggattcccaatgggtagcattggcattgatcttgggtgatgattattgaaattttcttgctctagaaaaaaaccagagacagttttattcagtggggtgataagaaaatggctgacagagtcaggtacaagtcccaaggaacaaccttgaaattatgtatatagattatcatgttgaattgtcttaaatttaggtgtgagctttggaaaaaatgccctcaaaaat

SEQ ID NO: 31395 - DNA, 500 bp, Homo sapiens
  misc_feature 7, 11, 29, 35, 39, 95, 402, 406, 420: n = A,T,C or G
agtaacnaacnaaaattttgttcggaccntcaacnaaanaaagtaaaagtgtccctgtattttgttgttagggtgggacctcccagaaggaagancgccttggtcacctggagccttctagtggggagtttacccctgtggaatggactcactttcaattttgaaacaatattacaggctcacgacagccccagtgagggccatgacgtggtcacataatgacatgtggatgttgacagcagaccacggaggatatgtgaaatatttggcagtcgaacatgaacaacgtcaagatgttccaggcacataaggaggcgattagagaggccaggtttatacacaatataccgttttctgtagtccctattgtcatggttaaattattctctaagtgtattcctngggngccaaagatgcatnggcctcttgtcagtttctggggaaactttctgcaccctataaacgcaatatttttctttgttttcacacattcaccattt

SEQ ID NO: 31396 - DNA, 279 bp, Homo sapiens
  misc_feature 7, 26, 38: n = A,T,C or G
tcggccnttatggcccgggcctaccnaacctaatgccngtgttgctgctgttgggtctgatgttcttcttttagatacctgcaggtcctattcctgtgcaagaatagggcagattatcaagatatccaggatacctatgaagttattatagaatatttattaatccattgaaattggataataagtttagaacataggttctcagtatctagaacttacatcattatctgtttgttaggatttgaaattctggaaaatatttatctacatcgcctcaga

SEQ ID NO: 31397 - DNA, 472 bp, Homo sapiens
  misc_feature 26, 398: n = A,T,C or G
caaccagctccggttctgtaaaaacnacagtgaaaggcctatgagatcagagagttgaaaaccactgcaggttcttcttcaaaggcaaacaacctccttgagccagcagccactcactatcaggacaaggaggccaagaaagaagagagaaggtcccttggtgcattttttccagtgcggtgagtggatgctatggagaactgcagctttcactccagcctatgacactagagtagagctctgcttgtttcccagccttcaagaaaaaaagagctggtatgtttcctgtcattatgccacatcattatagcttatttgctgtttgaaaggaattagttacccttacccaaattatatttaccaattgtgtttatagatttttatgtattcataggggntatgataatacaaattgactctactctgcacagcacagacccttccatcagaagacagagcctaacaacatagt

SEQ ID NO: 31398 - DNA, 469 bp, Homo sapiens
ggatgaagcaatctttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaacccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatatcgaaaagcacagaggatttctttagt

SEQ ID NO: 31399 - DNA, 481 bp, Homo sapiens
atggccggggagacgttctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgttgaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatcctt

SEQ ID NO: 31400 - DNA, 104 bp, Homo sapiens
ctgttcactcactatatttgatgtggcactctcacacttgatcttagccaaaaggccaagaagcaattggtgtggcactctcaaatttcccctttcttgacccc

SEQ ID NO: 31401 - DNA, 153 bp, Homo sapiens
  misc_feature 3, 13, 31, 32, 48: n = A,T,C or G
atngcccgggacnagtgtggcccgagcaganngccatgtgcctagagngcaaagagttggagttctatcttaggaaaatcaaggcccgcaaaggcaaataaatccttgttttgtcttcacccatgtaataaaggtgtttattgttttgttcat

SEQ ID NO: 31402 - DNA, 443 bp, Homo sapiens
  misc_feature 3, 16, 34, 45: n = A,T,C or G
ccngggaattcggccnttatggccggcatgcccnatgttgcaacnaagagcttctgggaaggtaagcggcatcggagctagatcacgtttcacaattagtggttgttcttttccgtgtttattttgcactttaaaaaagagagaacgcatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaattattcaagactggcacaaaagtataaatattattttatttcagggtag

SEQ ID NO: 31403 - DNA, 468 bp, Homo sapiens
  misc_feature 55, 120, 177, 225, 243, 258, 312, 327, 348, 429, 465: n = A,T,C or G
aaataaaggtaatggcaacaatgaaaaaaaaaagtaagtcatcctgggatagggngggagagccctaattcaatgtgactggtgtcctcgaaagaagaggggaatttggacacagagacncagctgaacttactgagcagagcctcccagatgctgcaaactcaaggaggcctctgngctcatatctttattctctctctctctctctctctctctgtctctggnacagcgtttatgcttttnggcagttctttcttnttcattcccccatctctccaattacacattcatatacacataaacactccgatnccctcaaactaccanaagccacgtcagagacttganaactttggaccaggaactgatggagacaaagatgacctaggaagatggctacattgggaatggaggcagagattggagttntgtggccacaagggaaggaactcctggggctcccanaag

SEQ ID NO: 31404 - DNA, 429 bp, Homo sapiens
agagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaaggggtacagttgcataaagtggggtttttatcctaatg

SEQ ID NO: 31405 - DNA, 450 bp, Homo sapiens
  misc_feature 14: n = A,T,C or G
ggtcggacgacagnaccgtgtgtttccaaaatggcggcagcgatggatgtggataccccgagcggcaccaacagcggcgcgggcaagaagcgctttgaagtgaaaaaggcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagggtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattct

SEQ ID NO: 31406 - DNA, 448 bp, Homo sapiens
  misc_feature 2: n = A,T,C or G
gnatgtaaacttcttttgctttaagatggaaatttgttacagggcaaatatcagtaagtgtaattttattaatcagtctcaatgagcatttgattctctgaccttggcaatgcctatacttttgtcctagaacacacaggaaaaaaggaagttaaggtaaccttattttctattggtcactacttacattttacacgtagttctaggtattccagcacagtacagtgaaaggagctttcattattcaaaatagtgttattgcttaaccttcactagaaaaattcaagcttattttcaattatgttcattaatttagttgactagcatttgttgaatatctattgtttttcaggcaatgtgtgacgttctgaggatatatacagacctacatccccctcctcgaggtttcagcctacacatttttagttaagaacaatatatttgctgt

SEQ ID NO: 31407 - DNA, 182 bp, Homo sapiens
  misc_feature 1, 5, 28, 37, 44, 48, 54, 69, 79, 80, 155, 165: n = A,T,C or G
ntggntagaattcatttgaccttgaganagcaatacntgcagcncttnaatganttttaccttgattanccaaatatcnncaatgacgatagccaggtatggaagactacaactcttctctcatttatagttgactatttataaagtggcagatntatggaatgntcaattcagtttttgtt

SEQ ID NO: 31408 - DNA, 398 bp, Homo sapiens
  misc_feature 15, 16, 17, 24, 351, 352: n = A,T,C or G
tatggccgggagaannnctgggtnatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgnnaaagagttctttatatattctgggattctagacccttatcagatac

SEQ ID NO: 31409 - DNA, 275 bp, Homo sapiens
gggtggctcattcctgtaatcccagtgctttaggaggccgaggcaagaggatcgcttgaacccatgagttagagaccagtgtgagtaacatagtaagacctggtctctacaaaaaaaaataaaaatgaaaattagtcaggggtggtggcacacatctgtagtcctagttgcctgggaggtttaggtgggaggattgcttgagcccagcagtttgaggctgcagtgagttatgatcgtgctgctgtgacagaatgagtccctgtctccgaaaaaaa

SEQ ID NO: 31410 - DNA, 472 bp, Homo sapiens
ggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatgg

SEQ ID NO: 31411 - DNA, 315 bp, Homo sapiens
  misc_feature 314, 315: n = A,T,C or G
ggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgccttcctgggtgatttgcatgtgtcttagtcttagtcaccttattatcctgacgtnn

SEQ ID NO: 31412 - DNA, 419 bp, Homo sapiens
  misc_feature 9: n = A,T,C or G
cataggatnaggatttgggaaccactttactaggaaagagcagatcagtaccatttgtataaaaccggcctcattatgtaagaaagaaaatgttacgtgttttcttctttagcttggttgtgggcacttctacagcaaggaccatatcatattcatctttgcatccctggcacagtgcatgagacataagtacttaataaatgcagttgaatggataatgattagtgttatttatggattagaaaaagcatgtttctatttaagtaagctgtaaaaagtattattgaatatttactgtaaatatatgttcacataaaaaaataacttggagggtctttgtgtccctggcatattatcatcttcatggaaagaatccactgtggtttctgtagagtgattggaaaaatggattattttga

SEQ ID NO: 31413 - DNA, 198 bp, Homo sapiens
gatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccct

SEQ ID NO: 31414 - DNA, 179 bp, Homo sapiens
  misc_feature 135: n = A,T,C or G
atctttgaatcgctgtactacaggaagatgtacggagacatggcatgaagccagagagtgagatgcgctttacgtgtaaaatacaggattccaaagacgtcgtataaaataatttgtatattgtttgcatgttangtaacatttttaatgtattggattaaataaaatgcattaaaatt

SEQ ID NO: 31415 - DNA, 109 bp, Homo sapiens
  misc_feature 11: n = A,T,C or G
attgctcaagnaaaaactggcagaatgtccgggccttatatatcaagagcaccatgggcaagccccagcgcctatattaaggcacatttgaataaattctattaccagt

SEQ ID NO: 31416 - DNA, 367 bp, Homo sapiens
  misc_feature 42: n = A,T,C or G
atgtacagacaccaacacagagtgttaaagaaaataaaagtnaggcaaagatgtatccaacaaagtaacatgatagaactccagaaacagacactaacaaaacagaggtatatgatttgcttgtcagagaattcaaaataacagtcataaaggtgctcatggaggtcaagagaacaatgcatgacaaagcaagcatttcaacaaagagataggaaatataaaaaagtactaacaagaaatcatagagctgaagaacatataactgaactaaaaaattcactataagtgttcaacagcagactatatgaagcaagagaatcagggaactcaaaaaacaggccactgtaaataattcaatcaaaggagc

SEQ ID NO: 31417 - DNA, 369 bp, Homo sapiens
aggaaaactagggacaggctgttctcttgcaattcaaaactgaacataaactgaaattgagagaaagtcatattaaatcctcatgtctgccatgtttgcagaggtcagctatacaaatatgaatgttaatttgaacttcaagaaaaggacactgctaaaatataatacatcttgaaaatgaagatgactctctacttgttttaatcagaacctcactgatatgtctcagggattaatttcatatatcatatccttaggctgagtgtgttggctcacacctctagtcctagcactttgggatgctgaggtaggagaattgtttcaggacaggagtttcagaccagcctggtcaacatggtgagctctcat

SEQ ID NO: 31418 - DNA, 145 bp, Homo sapiens
agtctttggactggttacttctggttttgaagtaatcgaacaaattgaaaatctgaagaccgatgctgcaagcagaccatatgcagatgtgcgagttattgactgtggagtacttgccacaaaatcaataaaagatgtttttgag

SEQ ID NO: 31419 - DNA, 403 bp, Homo sapiens
  misc_feature 9, 13, 139, 187, 190, 210, 220, 320, 344, 397: n = A,T,C or G
caatctaantgtntcagtggctgaatggataaagaaaacgttacacacacacacagacacacacgcacacacacacacgcacacacagaggaatattattcacgccttaaaaaagaatcagatcctgccatttgcagcntcatgaatggaactgggggtgattctgttaagtgaaataagccaggcntanaatgacaaatagcacatgtncctacccatntgtgggtgctaaaaagtttatgtcatggaagtagagaatagaatgatagttaccagagttttggaagggtgtggggctggggatgaagagaggctggttnatgggtacaaatacaccgttaganggaataagttctaatgttctgatagcagagtagggtgaatatagttaaaaatnacgtat

SEQ ID NO: 31420 - DNA, 363 bp, Homo sapiens
  misc_feature 4: n = A,T,C or G
taanataaaaatagttaaaccccaggcccgggaggggtagctcacacatgtaatcacagcactttgggaggctgaggtgggcggatcaccctgaggtcaggagtttgagacccggcctggccaacatggtgaaaccccatctctactaaaaatacaaaaattagctgggcgtggttgcaagcaccctgtagtcccagctactcaggaggttgagacaggagaattacttgaacctgggagacagaggttgccgtgagccaagatctcaccagtgcagtacagcgtgggtgacagagcaagtaagtaaagagggagggtttggaattagatattttggtgtatgaatggatgggcctaaagtgc

SEQ ID NO: 31421 - DNA, 210 bp, Homo sapiens
gcatgtaccttctctttttaaaactttttttaactagttgccacagaatttgcaatatacatttacaaccaattcaagtccactttcaaataacactatcccactatcccacgaataagactacctgcttaacaaacaaaacacctaattcctcagtaacatttacaacaaattcaagtccactttcaaataacactatcccactatccc

SEQ ID NO: 31422 - DNA, 280 bp, Homo sapiens
gagtaagttaccgctctcctggagcacagaacggacttttcgtgtcccgctgtaaggaaacaagatggtccttaaaaccgaagaggaggacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcagg

SEQ ID NO: 31423 - DNA, 472 bp, Homo sapiens
ctccttcggaaccaatggctcagccacccaggtgggcaccaacacttgaatacactccagtctctccctcttctgacccctttactttctgcactgctgctgctgctaccttgcctgagatattcctccctcccagactcttcactccccttcccactgctgaggagctccccttccttgaccggccagctcacattctgtcttcatcataaagcgctctccctcttcaagaagcacattcagctaacagcgctctcgagaccagcctgggcagcatagttgagacccccgtctgtactttttaaaaataaaaataataaaataaaaaatttttaagggaggtaataaacaacaaggtcaagcccaccattacagctgattaaaatctaataaatataaaaggaatgataacatcagaaaatcaccataactgtcatagctacaattaattggggcaagagtcatcaaggga

SEQ ID NO: 31424 - DNA, 222 bp, Homo sapiens
ggaaattattttaaattgaattttagtgattttttgtggtatttatgttcaaaaagccatacccgacaagtcaagccatttcagaaaaatgtttataaatgtatgaaaaagttgtttgtgtggtgctgaacttggatatatattactgcatatcaatgtgaaaacattgtgtcagcttcaaagcattgtgcatattggaagacattattgctattgttaata

SEQ ID NO: 31425 - DNA, 445 bp, Homo sapiens
  misc_feature 5, 25, 30, 32, 43, 55, 76, 92, 98, 128, 138, 196, 266, 344,355, 392, 411, 416, 436: n = A,T,C or G
tgggnaccttgaggtcaggagttcnaggancnagccctgtccnaacctggtgaancccctgtcctctgcctaaaantaccaaaaattagccnaggccnttgtcaccagtcaccctgtaatccccaganacctcaggangttgaggtgggagaatcgcttgagccccgggaggtgggaggttgcatgaccccaagantcatgcccacctgcaccgccatccctgggtgacagagtgagacccctgtctcaaaaaaaaaaaggaaatncttaaaatatgttattttcaatgtaattttaaactttgtttctttggctttgttttaacatctggaattccttttatntcagctatttnctttaaaagtttttatttaaaaattgttttactttanatatagaactttacttttnggacnccagatggctaatttatagngaaaatggt

SEQ ID NO: 31426 - DNA, 453 bp, Homo sapiens
  misc_feature 4, 5, 36, 41, 48, 55, 56, 60, 73, 110, 117, 164, 188: n = A,T,C or G
tctnngggccgggggaggtgggcaaagggaagtacnagacnccccgangttgtcnngganagttttgggaccnagaggctcagtggtgggaagaagatcccctgcagaancccaccnaaccccgaaccgtggtttgccctgaggctgtaacctgagagaaaganttctggggcctgtgttatgaaaantatagacattctcacataagccccagttcatcacccatttcctccttttacctttcagtgcagtttcttttcacattaggctgttggttcaaacttttgggagcacggacttgtcagttctctgggaaagtggtcagcgcatccctgcagggcttctcctcctctgtcttttggagaaccagggctcttctcaggggctctagggactgccaggctgtttcagccaggaaggccaaaatcaagagtagaagtaagaaaaagttgt

SEQ ID NO: 31427 - DNA, 500 bp, Homo sapiens
  misc_feature 6, 9, 28, 50: n = A,T,C or G
tgcccnccntgagtggaagagtggaganctactggattgacccccaaccnaggctgcacccttggacgcccatgaaggttttctgcaacatggagactggcgaagacttgcgtctacccccaatccagcaaacgttcccaagaagaactggtggagcagcaagagcaaggagaagaaacacatctggtttggagaaaccatcaatggtggcttccatttcggctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaaagactgttattcgagta

SEQ ID NO: 31428 - DNA, 236 bp, Homo sapiens
  misc_feature 2, 3, 8, 9, 14, 16, 17, 23, 24, 26, 30, 34, 36, 42, 44, 47,50, 54, 57, 76, 78, 79, 80, 85, 104, 113, 140, 157, 236: n = A,T,C or G
anntacanngcggngnncctgtnncngacnctgngncactcnanagnggncatnccnggccgtgagcgcacacgancnnngctgntggattgacttatggcggnagcatcaanttagctttagtgctgataatacattanttactaaagtaaaagtngattttctcttgaacaaaaattatatgtattattaatatacataaaatatgtttgttcacattttgaatacattggaan

SEQ ID NO: 31429 - DNA, 132 bp, Homo sapiens
  misc_feature 32, 42, 45, 53, 58, 69, 85, 88, 100, 105, 122, 125: n = A,T,C or G
tccaagccacttttggggaatgccccgggggnggggtgggantcnaccctgantgtcnagggagttccnagggagttccgaaganccnagccctggcccnaacantgaatgaaaactccctntcntcttacc

SEQ ID NO: 31430 - DNA, 215 bp, Homo sapiens
  misc_feature 11, 16, 36, 40, 41, 44, 59: n = A,T,C or G
gtgagggaaanctgangtaaagttaaagtaacctcnaganncanaaggtaattaggganaagagctgggattcataccataggtccttatccagtgcccatgcctttaaccatttaacctctactgcctcttggctataagtatttattgtaatttcaggcttttttcttaaatgaagtctgccaaacaatattcttcttaattgagggtactac

SEQ ID NO: 31431 - DNA, 370 bp, Homo sapiens
  misc_feature 60, 143: n = A,T,C or G
aaagtggtggtccttgggaaacctcaccactagggtcccagggaaataggtattcctgtntccccactcaaaatattgcctgggaagaaaacctcataattcaccaggggtattggtggaaagaggtacctccagggaaagancctttcccctttaataggtagaattatggaatttagcccttagaccggcttcccatttctgcccaaacaaattataaaatcaagagtcaaaaaaagattaaaatgttttcatgtaatttaacagcatcccaaaaaaagactcaaaattttaagaaatatcaaaatatccagcacccaacaaggtaaaagtcacaatgtctagcagctaatcaaatattaaaggcatc

SEQ ID NO: 31432 - DNA, 407 bp, Homo sapiens
  misc_feature 8, 23, 30, 83, 97, 106, 110, 251: n = A,T,C or G
ttaagccntccagccttgtcccntaagaangccagtttggtccaccactaaaagggaagtctttaaggggacctttggaaaantgtattccattgantaaacctantaanttttattttggatggtttttggatcaaaagaaataacccagatgcccattattttttccctgaaagggaaattgcctggaccatttaccaccttgtttttaggggtgtcattcattttcaccagaggtttaaatacctggngggagtgaccacccagaaccacagcccgaagaggcctagaaagccaagaaaaggatctgcatgataacctttgcagcttgagaatagttccctaattcattcaacgtaacaaacaaagcttttggggtgtcccatgatatacccaggcactatgct

SEQ ID NO: 31433 - DNA, 492 bp, Homo sapiens
  misc_feature 13, 38, 39, 42, 50, 52, 64, 112: n = A,T,C or G
gaggacctttaangacggttaagaccttgggtaaagannganacctctcnantgaccaaccccntgggggcctttttaaaattactacctagtggatgtgtatttttactanttcagttgatccctagtctttgtaccagtcagttttcttttacaatctggaattttgcccatggtttcaaggcccagcatgggtatttactaagtaatcttgaggatgactgttcttcttttgtaaccctgctctctccagatctgatctgtatctgttttaacccagaagatgtgcccttttgcttacaccatccctcttgttttaagttaaaaagacaaaagctacccgatctactatgtcataggaattattatggatattctctacctctctagccctgtattaaaaaaatctaacttgctgcgtagtgcttttattttataaactatttttaatcattaaaaaattcaaatttatttgattaaaatattaaaatt

SEQ ID NO: 31434 - DNA, 466 bp, Homo sapiens
  misc_feature 7, 14, 45: n = A,T,C or G
cgggaanttcggcntttattggcccgggggcctctttccggggancgttgtctgcaggcacctcaaaatggtccagcgtttgacatacccgacgtaggctttcctacaatacagcctctaacaaaactaggctgtcccgaaccccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgtttgaaggcacaagcacagagtcagaaagctaaataaaaaaatgaaacttttttgagtaataaaaatggaaaagacgct

SEQ ID NO: 31435 - DNA, 117 bp, Homo sapiens
  misc_feature 3, 6, 10, 16, 22, 27, 112, 115: n = A,T,C or G
aanctnggtntcctcnaagccncaaantaagccaccagaagacgggagggaatgcctggttttccccaaaagaaagtgaccttccgaaaaaccttttcctggaaagcctgantanct

SEQ ID NO: 31436 - DNA, 209 bp, Homo sapiens
  misc_feature 7, 12, 30, 37, 55: n = A,T,C or G
tggcccnggganggcctttgaggccagccngccgccngggcctttcttgcctgangggggccaggccggagccttgaggaaacccgcagcataagtttttttctctttgaaagatagagattaatacaactacttaaaaaatatagtcaataggttactaagatattgcttagcgttaagtttttaacgtaattttaatagcttaagat

SEQ ID NO: 31437 - DNA, 407 bp, Homo sapiens
  misc_feature 16, 18, 27, 28, 29, 30, 37, 38, 47, 48, 72, 73, 81, 85, 87,88, 91, 102, 117, 118: n = A,T,C or G
tgggccgggagccccnantgggtgaannnnagtaccnntcagtttcnntttgggctttttgggcccctgaannagacgacnagancnnaangtgtcactgtnttgttttttaaagannagaattcactctgaaatgaaagttctgtagccatgcttataaaccccttggatagaaagaatgggagttgggcttttctacaatcctgtttgtgtttctcaaagtgtagttttatgaccatctataataaaaaacctttggaatatttgttaaaaatcaaatgcgcaggcttctgggccaggcacagtggctcatgcctgtaatctcagcatgggaggcctatgtacaaggattgcttgaactcagaagtttgagaccagtctaagcaacatagtaagaccctgtatct

SEQ ID NO: 31438 - DNA, 423 bp, Homo sapiens
  misc_feature 3, 7, 29, 37, 54, 110, 422: n = A,T,C or G
aanttcnttccccaactttaagtaaaganacttcctnttctgctagctttttanaaaactgataaaaaactttggaaaattttggtagtcacatttgccaataccaaganagataatgcacctgaaatgaaggcagcacagccagacgcggtggctcgtgcctgtaatcccagcactttgggaggccgaggcgggtggatcacgaggtcaggagttcaagactagccctggccacgatggtgaaaccccgtctctacccaaaaatacaaaaagtagctgggtgttggtggtgcatgccctgtaatcccagctactcaggaggctgaggcagagaattgcttgagccagggaggccggaagttgcagtgaggcaagattgcaccactgcactccagcctggatggcagagcaagactccatcnc

SEQ ID NO: 31439 - DNA, 500 bp, Homo sapiens
  misc_feature 5, 17, 40: n = A,T,C or G
acccngggaattcggcntttattggccgggggggcggacnctgcagactgagcggtggaccgaattgggaccgctggcttataagcgatcatgtttctccagtattaccctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttggtgtgaggcaatcattggtggcatcacccataaagagaacacatttgacttttttttctcatattttaaat

SEQ ID NO: 31440 - DNA, 461 bp, Homo sapiens
  misc_feature 7, 10, 23, 27, 33, 36, 49, 57, 135, 178, 195, 252, 337, 461: n = A,T,C or G
cgggaanccnaatccgttgcaancccnaagganccnaagtacttttccnaattctcnagtcacttcttaggaactcttgcacttgaatggcttgacctgaccttgatgtccatttcattcccacccttcttcacnagttcggaactttttcttcccccttcttcttttctaagaagancctggaactgggcaganctgcaaaaataaaatcttcggtgttctatttatttttatttgtcttccctgtaaganccttcgggtcaaggcagaggcaggaaactaactggtgtgagtcaaatgccccctgagtgactgcccccagcccaggccagaaganctcccttcaggtgcccgggcgcaggaactgtggtgtgtcctacacaatggtgctattctgtgtcaaacacctctgtattttttaaaacatcaattgatattaaaaatgaaaagattatttgggn

SEQ ID NO: 31441 - DNA, 239 bp, Homo sapiens
  misc_feature 16: n = A,T,C or G
cctgttttgtttcaanttggcccattttaagtttagtaggtaaaagacctggttaatgataacaatgcatcgtaaaacccttcagaaggaaaggagaatgttttgtggacccactttggttttcttttttgcgtgtggcagttttaagttattagtttttaaaatcagtactttttaatggaaacaacttgaccaaaaatttgtcacagaattttgagacccattaaaaaagttaaatt

SEQ ID NO: 31442 - DNA, 449 bp, Homo sapiens
  misc_feature 2, 3, 43, 47, 49, 59, 92, 243, 299, 301, 336: n = A,T,C or G
tnnagaggcccgaggtgggtggatcacttgaggtcaggagttnagancngccctggccnacatggtgaaaaccccatctctactaaaaatantaaaaatcagcccgggcattggtggcatgtgccctgtaatccccagctactcaggagtctgaggaggagaatcaccttgaacctggaggcagaggttgcagtgagtcgaggttgcgctactgccctccagccctggacaacagagggaganctctgtctcaaaaaaaaaaacctacagctgttcaaggaccagctgacaggtcaagngnggccttttctggtctttgaacacatcatagaaagngacaaatgctgcaaagccatgaagaacatgaactataaacgggtagactaactgcccagcttaaacacttatctatgccacaaaacagctgaatttgtcacatttatatattg

SEQ ID NO: 31443 - DNA, 390 bp, Homo sapiens
  misc_feature 12, 15, 38: n = A,T,C or G
ggcccgggagangcnaatgttttgaaatgatatgaccnaaaattttaagtaggaaagtcccccaaacaccttctgctttcacttaagtgtctggcccgcaatactgtaggaaccaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccac

SEQ ID NO: 31444 - DNA, 151 bp, Homo sapiens
  misc_feature 5, 13, 28, 33, 56: n = A,T,C or G
aaaancagttctnaatttccttttttantgtanttgttttacctcctttttatccntaccgtaaaattttggattaatttgtgaaaatgtaattataagctgagaccggtggctctcttcttaaaagcaccatattaaatcctggaaaact

SEQ ID NO: 31445 - DNA, 417 bp, Homo sapiens
ggacgaaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtaagtgtctcaaagacacaataaacttcctatggtctg

SEQ ID NO: 31446 - DNA, 164 bp, Homo sapiens
  misc_feature 2, 4: n = A,T,C or G
antnttcagattgagggataatgaaaattcaatattatatttcaaaatttgtggggtgcaggtagagcagtgcttagagggaaattaatagctctaatgtgttagtattagaaaaagaaggaaggtttaaaattagttatccaaatttccatttttaaatgtag

SEQ ID NO: 31447 - DNA, 423 bp, Homo sapiens
atccccttctctcccctaggggctcgtggtctggaagaaacatgtatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttggggtttttatttataatgcctgaagttattccatataagtatcaagttaaacacaattcattttgattataaactatttgactttttaaaatcttctgacacagtaaatatatatatcaagatttgatgtatcaaaaatttattgcacactttaaagtg

SEQ ID NO: 31448 - DNA, 470 bp, Homo sapiens
gaacttaaagtggcagtgtgaataataatctttatgatattttgttaaatgaaaagccacaagcctgtattcaacatgtgctgccttagacacatatcagtagtaaatataaactaagaacaaacatgtaagaaactgaaaaacatttgtttcttctctagagaatctaggcaaaaattcccagaagataccttaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggggtctggacaaagtgccaaaggatcttcc

SEQ ID NO: 31449 - DNA, 374 bp, Homo sapiens
attgtttgtttaccacagatttatatttgagagtaagagttgatattaatacaaatggcatgtgccttttctgatattactcttagaaataagaagaaaatgctgggtgtggtggctcacacctgtaatcccagcactttgggaggctgaggtgggcagatcatgaggtcaggagttcgagaccagcctgaccaacatggtgaaaccctgtctctactaaaaatacaaaaattagctgggcgtggtggcgcatgcctgtaatcccagctactcaggaggctgaggcaagagaattgcttgaacctgggatgtggaaggttgcggtgagctgagatcacaccattgcactccagcctgagcaacagagcaagatg

SEQ ID NO: 31450 - DNA, 103 bp, Homo sapiens
  misc_feature 4, 6, 7, 17, 46: n = A,T,C or G
ggtnannttttgtaganacccgggaatgatcccctcagtctgagangttagaatgatcatctgtaatctgagggttaatttctaggcaggtggagagagtggt

SEQ ID NO: 31451 - DNA, 411 bp, Homo sapiens
  misc_feature 4, 7, 63: n = A,T,C or G
gagngcnagccccgccgccagggggccttcttgcctgaggggggccaggccggagccttgagngaaacccgcagataagtttttttctctttgaaagatagagattaataccaactaccttaaaaaatatagtcaataggttacctaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagctccgaattaataccaatagaagggcaatgcttttagattaaaatggaaggtgacttaaacagcttaaag

SEQ ID NO: 31452 - DNA, 157 bp, Homo sapiens
  misc_feature 28: n = A,T,C or G
atcttattttatatttgttctattggtnatttaagttttctttttggcaaatttcctatgcatattcttattttttctgttggattgtctttttcttattcatttaagtttgttgtggtgcctttcattgagcaaaaactttaaattttaatgtgac

SEQ ID NO: 31453 - DNA, 134 bp, Homo sapiens
  misc_feature 3, 20: n = A,T,C or G
aanttcattgaacagaaaanaagtacgcatttactctacccacacagagacggtagcacacaggaaaaatggttggggagaaagggtgctgattataaagatacctattatagaccaattcaggtcccaggggg

SEQ ID NO: 31454 - DNA, 408 bp, Homo sapiens
  misc_feature 7, 9, 32, 33, 379: n = A,T,C or G
aagaacncnagtgaacctcatcactttggttnntcaaaaaatcctcgcccatgcgttattcctgagtgcattttcttacaactttttgactgcttccttttcttcttctcttaagaagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgaggggtctgtacctaaatttaaaaaaaaaaacacgtanaactaggtattttttgttctcttcttagt

SEQ ID NO: 31455 - DNA, 275 bp, Homo sapiens
  misc_feature 2, 20: n = A,T,C or G
antggtggaggaggaagccntgtcagaaggataagaaatcggtggttgctgaggtggaactgtgggagtgggaagggctagatgagggagcagtgggaggtgttggtcatcatgcgcttttccttaggtacagaaagaagggaaatagagtgagccagactgcaagaggattttgaggtggagagggtgtgagtttgaggagcctccaacagaaaacttctttgtacgggattaggtgaaatcacttgtggagtgaggaggaaaaggatttggtg

SEQ ID NO: 31456 - DNA, 461 bp, Homo sapiens
  misc_feature 2, 13, 429: n = A,T,C or G
tnggccggggaantttcgttgggtgggtgttcagttgtggcggttgctggtcagtaacagccaagatgctgcggaatctgctggctcttcgtcagattgggcagaggacgataagcacctgcttcccgcaggcattttaaaaataaagttccggagaagcaaaaactgttccaggaggatgatgaaattccactgtatctaaagggtggggtagcctgatgccctcctgtatagagccaccatgattcttacagttggtggaacagcatatgccatatatgagctggttgtggcttcatttcccaagaagcaggaatgacttcagtcatcccagcaatcgcttggttcagtttcattcagctctctatgggccagtaatctgataaataaccgagctcttctttggggatcatattttattgactttgngagtaacctgccaccaataaaagcagtcttta

SEQ ID NO: 31457 - DNA, 147 bp, Homo sapiens
  misc_feature 25, 27, 38: n = A,T,C or G
aggggtggttttactgttcccaganantagataaaacnaattttgtcccagtttgttaggataaatagcagtaggtaccattactgtttgtatttcagattttcacatgagagatgttcaaccctataagtataatgcaaatattcc

SEQ ID NO: 31458 - DNA, 364 bp, Homo sapiens
  misc_feature 35: n = A,T,C or G
gggtctcggccgcagaagcgagatgacgaagggancgtcatcgtttggaaagcgtcgcaataagacgcacacgttgtgcccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaat

SEQ ID NO: 31459 - DNA, 412 bp, Homo sapiens
  misc_feature 7, 23, 36: n = A,T,C or G
tcggccntttatggcccggggancggaggttgagangaaagcttcttcatggagtaaaaaatgtatttaaaagaaaattgagagaaaggactacagagccccgaattaatacccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggggtggtaggatgaaacaatttggagaagatagaagttttgaagtggaaaactggaagacagaagtacgggg

SEQ ID NO: 31460 - DNA, 458 bp, Homo sapiens
  misc_feature 2, 25, 73, 80, 271, 424: n = A,T,C or G
cncccctgcccttgttctaagtgcnggggcctcttggatactgcttgcccaaacctcattggcttcttggacnaaagccnagaatttggatccctaaattaaaggtgaaaaacaagactctaaactcattaagctccattaccattcaagtagggcttttgtacagtttctgaccacttgagttatagaaaatgattgaaagatttttgttttttccccccaggggctgggggagaacttcataaaacttgttcatgtctgtggtgaattngaaagttcctctacttattttagtccttggagaaatgagattaatgggggggttcaaactgtttttctaagtgtgacagtcatttccacgggtttgagttttgccaggttattttttggctggcttcatactcactccaaagaaaaagagtgnggggggaaaaagcaatattgagagcgagtaaaac

SEQ ID NO: 31461 - DNA, 424 bp, Homo sapiens
  misc_feature 6, 9, 37: n = A,T,C or G
agtacnacnctgaggtgaaatgaaattagatgagacntaatgagatgaaatgaccctaatgaaatgaaaaaatgaaatgaaataatgaaatgaggtgaaattaaatgagatgatgaaattaaatgatgaaatgaaataatgaaatggaaatgaaatggaaatgatgagatgaatgatgagatgaaatgatgagatgagatgtaatgatgagaggaaatgatgagatgtaatgaaatgagatgaaatgaatgagatgaaatgaaataatgaaaggaaattgaatggagatatgagatgaaatgagataaaatgagatgaaataaatgatgagatgaaatgatgaaatgctgaggtgagatgagatgaaatgagatgaaacgatgagatgaaatgaaagaatgagatgaaatgatgagatgaaatg

SEQ ID NO: 31462 - DNA, 477 bp, Homo sapiens
  misc_feature 9, 17, 38, 39, 47, 49, 52, 471: n = A,T,C or G
cccgggaanttcggccntttatggcccgggatgagtgnnctgagagnanaanctggagaagagtttttcccaacatccaatagtcttcttcatggaacccatgtgcccttccacagaggaaattgacaggatggtcatagatctggaaaaacagattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttaagtagtccatgccttctcactcagcatttagaaataaaatgtgggggttcttnaaccgt

SEQ ID NO: 31463 - DNA, 110 bp, Homo sapiens
  misc_feature 2, 17, 35, 41, 42: n = A,T,C or G
gncctgagtctggaganttgcttgaaccccggganttaganngttgcggtgagcccgagatcgcgccactgcacctcccagccctgggcaaccaagagtgaaactcccgt

SEQ ID NO: 31464 - DNA, 460 bp, Homo sapiens
  misc_feature 5, 12, 20, 370: n = A,T,C or G
ccgantagcacnagaagagngaagatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggccctgtggtatatgggaaaagtagcangggtggtcaagggtggggagacaccaagatgtttttatagtctagagcctttaaaaaacccagcagaatgtaattcagtatttgtttatt

SEQ ID NO: 31465 - DNA, 214 bp, Homo sapiens
  misc_feature 1, 15, 30, 36: n = A,T,C or G
ncgggaattcggccnttatggcccgggatntgaganagggtcttgctctgtcaccccaagttggagtacagtagcacaatcacagctcactgcagctactcgggaggctgaggcaggagaattgcttgaacccagggggcagaggttgcagtgagccaagattgcgccactgtactccagcctaggcgatagagcgagacttcttctcaaaaac

SEQ ID NO: 31466 - DNA, 449 bp, Homo sapiens
gtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggctggaggtgggcaaagggaagtaacagacacacgatgttgtaaggatgggttttgggactagaggctcagt

SEQ ID NO: 31467 - DNA, 464 bp, Homo sapiens
  misc_feature 2, 10, 368, 371: n = A,T,C or G
cngttctccnaatccctgatttgtaggttctgcaggcctttttagtaaaaatggagaaactgattctgacattaacatgggcatgccagaagactgcgaatagcccagaacagtttttgaaaaggaacaaagttagagggcttgcatgacttgacttactctatgctgctactaagacaatgttgtattggtggtaataatgagatataaatcaatggaacatccaaaaatagacccacacacccatactgacctgattttcaacaaatatgtcaaggtaattcagtgggagaaagataatcttttcaacaaattgtgctggaacaaatgaatattcttaggaccaaaaaaaatgaatttcaacctcncancaatataaaaattaatagaagtgagttctatttccaaatgtaaattatatctcaaaatgtaaaaactaagattatagaacttctaaaagaaat

SEQ ID NO: 31468 - DNA, 404 bp, Homo sapiens
  misc_feature 7, 13: n = A,T,C or G
gagtgcnagcccngccgccagggggccttcttgcctgaggggggccaggccggagccttgaggaaacccgcagataagtttttttctctttgaaagatagagattaataccaactaccttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagct

SEQ ID NO: 31469 - DNA, 465 bp, Homo sapiens
  misc_feature 5, 11, 25, 42, 45, 461: n = A,T,C or G
cggcntttttngccgggaagaattngaaaccttttaaaaaanacnaaatagaaatccaaagactgaaaactacagtaacggaaataaaaattttactaggtgggcttaacaggagaattgagatgacagaagaatcagatccataaaaattcaggctgggcatggtggctcacgcctgtaatcccagcactttgggaggccgaggtggttggacacctgagatcaggagttggagaccagcctggccaacatggtgaagccctgtctctaccaaaaatacaaaacttagctggccatgctttcacgtgcctgtagtgccagctacttgggaagctgaggtaggagaatcacttgaacccaggaggcaaggttgtagcgagctgagatcatgccactgcactccagctttgggtgacagagcgagactgtctcaaaacataaaataaaaataaaaattggangatt

SEQ ID NO: 31470 - DNA, 469 bp, Homo sapiens
tgcagtggctcacgcatacgatcccagcactctgggaggccaaagcaggcagattacttgagcccaggagtttgagaccagcctgggcaacacagtgaaacccgatctctatcaagaaaaaaacgccggatgtggtggtggtacatgcgtcacttgagcctgggtggtagagagtgcaatgagctgcgaacacctaagcgcacttcagcgtgggctacaaagcaaaagaccctttctcaaaaacataaaacaaaataaaataaaataaaaatggctctaagtcagaggagccacaggtaagttcacaaaatttagaagccttggctgggcgtggtggctcatacttgtaatcccagcactttgggaggccggggcaggcggatcacctgaggccaggagttagagaccagcctggctaacatggtgaaacctgtctctactaaaaatacaaaaaaattagctgggcatg

SEQ ID NO: 31471 - DNA, 180 bp, Homo sapiens
ggggcaagcacttcagcaaccccaaaggagctcgtcactggccatgacaggacatgctggcagcttcatcaaggaatgccgagaagactattacccggggaggctgagatctcaggagagctacagtgatatgtctagtcagagtttcagtgagacccgaggcagcatccaagtccccta

SEQ ID NO: 31472 - DNA, 297 bp, Homo sapiens
  misc_feature 42: n = A,T,C or G
aggaatgcagaatctcaggactcactccagatctaatgaatnagaatctgtactttaacaagatcccaggtgatttttatgcacagtaaaattggagaaggctgagtcaacaagtcaacatgcaagtggagctcttgcactccacatagctagatgtattgtatgatggttgttcctccctaagaatgctatttgaaaacaaacagagccattaacagctcctgtcttgcttggcttggggagcagttgccattttaaagggcagaaatgctgctcccagaaagtaaagagacaaca

SEQ ID NO: 31473 - DNA, 267 bp, Homo sapiens
  misc_feature 8, 14, 15, 21, 41, 239: n = A,T,C or G
cagaatcnggaganncgcacnagccccacccactctgagangacagtggctgacttcccgtgctgggcttttccattgtccccctggagtcagggctgggttttggattaaccccatccttcctagttaacacctttttgtttttattttattttatttttgtttgttttctccgtgtgtgtgttttcctaatttatttacctctgtttcccctttttcctttttttttttaattaaanagcaaagctttttattactttgtaattt

SEQ ID NO: 31474 - DNA, 472 bp, Homo sapiens
  misc_feature 2, 12, 452: n = A,T,C or G
ancattaagccnttttaaaaagttccatacctgtattagcatccttagaagggacagaactaagaaaatacattgctcaaataatattttacctttattgataatgacaaaaagaatattttttaaaccccatcaaaatagatttcaattgactgtttcccctacatcttttgagccacagtcgcccatcgaataagcaaatttgtttttgagaataaactggtaaccagtttgtgatgactctcagaagccttttggctgggatacagaagagtttctaagttcctagagagccatttaataattagtttgggtgagccagaggcttgacagagctgttacttatgtgtgagggcctttattctcaggcagtagtttattcatcatttgggtaagcccctccccacactcctctaatttaaacaagtagtgaaggcttatcttaaactggngtagtaccttagacttggca

SEQ ID NO: 31475 - DNA, 214 bp, Homo sapiens
  misc_feature 21, 25: n = A,T,C or G
gaggtcaggagttcgaaaccngccnacatggtgaaacccccgtctctacaaaaaatacaaaaaaattaaccaggtgtggtagtgggctcctgtaatcccagctacttgggaggctgaggcaggagaattgcttgaacccaggaggcagaagctgcagtgagctgagattacaccactgcactccagcctgggaaacagagcaagactctatctc

SEQ ID NO: 31476 - DNA, 468 bp, Homo sapiens
  misc_feature 402: n = A,T,C or G
cacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccctaaaggaaccaatgagtccctggaacgccagatgcgtgaatgggaaaganaacttttgccgttgaagctgctaactaccaagacactattggccgcctgcaggatgagattcagat

SEQ ID NO: 31477 - DNA, 457 bp, Homo sapiens
  misc_feature 3, 18, 25, 39, 41, 50, 56: n = A,T,C or G
ccngggaatttccggccntttattnggccccggggaggncntttgaggcnagcccngccgccggggcctttctgctgaggggggccaggccggagccttggggaaacccgcagataagtttttttctctttgaaagatagagattaatacaactaccttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaaggtgacctaaacagcttaaagtttagttt

SEQ ID NO: 31478 - DNA, 473 bp, Homo sapiens
  misc_feature 4, 42, 292, 457: n = A,T,C or G
ggcncctggatatggctgtgagagccgatcactcattaaatnaggtggttttgttcctgaatcaatcttgcatctcagtagatttttagtccccgaggcccagactgccaacaaaaaatctttcagggcattgtaatattttgatgaccacagacttccttggaatgaagttgtcccaattccaaatgaggggccacggcctcataaaaggtttttattcccctttctgggctggagaagccatctaggaaaatgctgtttctgtacctaaagtgttgggggattttcaganttgttttcatgagttacagacacacggagcagcatgcttgaacttagaccctttctgcaaatgtcaggctgtatgataattgagccagaatgttactcgagctttctgacacattttttgagacctcccatccagtattctcatacagaaatatggctcctccangtgtgcacttaacact

SEQ ID NO: 31479 - DNA, 473 bp, Homo sapiens
  misc_feature 323: n = A,T,C or G
gagagccgagtacgagtctgaggcggagggagtaatggcaggacaagcgtttagaaagtttcttccactctttgacccgagtattggttgaaaggagtgctgctgaaactgtaacccaaaggaggcattatgcttccagaaaaatctcaaggaaaagtattgcaagcaacagtagtcgctgttggatcgggttctaaaggaaagggtgggagagattcaaccagttagcgtgaaagttggaggataaagttcttctcccagaatatggaggcaccaaagtagttctagatgacaagggattatttcctatttagaggatgggngacattcttgggaaaagtacgtagactgaaataagtcactattgaaatggcatcaacatgatgctgcccattccactgaagttctgaaatctttcgtcatgtaaataatttccatatttctcttttataataaactaatgataactaatg

SEQ ID NO: 31480 - DNA, 301 bp, Homo sapiens
  misc_feature 4, 13, 48: n = A,T,C or G
gaancctgaagcngaataaaacctcatttatttgcaaaacaggagaanagcccttctatcctaaatcatttaaaagtaaaaaacaaaagcccatctagggtcttatattcaagtacctgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagag

SEQ ID NO: 31481 - DNA, 471 bp, Homo sapiens
  misc_feature 34: n = A,T,C or G
gaatctagataaacacaaagcctaatgattaccnaatacattgttacttccccatgttgaacatgggaattattatttgtagtggttttctgcatttttttcctgccctttacagatcatgaaatgcgttttgaaatcaagacaattctcaaaggtcttcataagctgggattgtttacggagcaaaaactcagctctcaacaaatatttgcaacttaatgatacatttgtataaagcctcagaatttttgtgtagaacaggtgtcagtcagtgtatatttcactgctctgttaagcatctttcccttgaaattactccccatcttacatggcacagacactgaagtggtcatttatttttaaattaacttagtgctgggcctgggaaaacatgggaaaagataatggcaaaaattattccaacaaggtcacctggagcttacagtgagctgagatcgcaccgctgcactc

SEQ ID NO: 31482 - DNA, 416 bp, Homo sapiens
  misc_feature 414: n = A,T,C or G
gagtattatattgtacgttggagctaggtatttaagaatatttgggggtggggagggaagactccaatttactggtggtgcttggccagtaatcaaggtgacagtttaagtattgggtcttgcactgtaaactcctgcttatctagacttcagactaccacagagcccacacagccaggaagtctgtctccccatttagtcttatgagcaagatagatgaagccatgagaaaatatactcaaaaagcaaccaacagacaatgtcatggaatgaatctcctacagatttttccttacacttttgaaaagtaacatgattttaaaacgttgggaaaattcattcaaggtacaaatcattttctgacttcagcattgatacctaaattgatttccagtacacagtttatagaattgngg

SEQ ID NO: 31483 - DNA, 357 bp, Homo sapiens
  misc_feature 3, 11, 27, 28, 30: n = A,T,C or G
aanttcggccntttatggcccgggaannanccggggccgccgtggccccagataagaaaataggtgttcctttgtgctcataaaacagaatgcggcgatggttgctttagccgtttctcaccatgcaatgcagagggacaaagggctgtgctacacttcccagttacattctgaagctcataaatgtatgagaaggtttgtgattttgcacaaggtgtgtgtagtaagttaaattgttgaacacaaaaatgttgctgcttgaggcataagttggataataggctttaaatgatcagggattcaggttcataatgaacttcacagtaaagaacacgtttgttctgcaaagcattgaac

SEQ ID NO: 31484 - DNA, 459 bp, Homo sapiens
gttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaagtatatgaaccaaagtgatttgagtttgtaaaaatgtaaaatagtatgaacaaaatttgcactctaccagatttgaacatctaggtgaggttcacattcatactaagttttcaacatttgtgttctttttgcattcattttttactttttttaaaag

SEQ ID NO: 31485 - DNA, 271 bp, Homo sapiens
cttctcaatctcctctaatcgatctgaattcccagttttcaatggactccttgtatgtttcggatatatctgtgagtttggttaattatcagagtaactttcactaatttgctatctaagagaaaagtgataggtcagtaaaatggaaaagtaaacagtttgaaaatgcatgacttcagaaaagtgtattaattagcattatttgaatgggcctcattctctgcttatcaaaggatcagtggaaatgggcagggcagagggagatctaaca

SEQ ID NO: 31486 - DNA, 305 bp, Homo sapiens
aaaagagtttattcttaggtcctagtagaagagctaacctcacactcatcccattctaaactatgtgattcaacactgattttacatccaacaaagtgaaatcttgatagttgggtgtaaaaaggagagtaatggagatttcagagtagttggggttgcttacttttcatttttaattctttaggttttgtaagttacacacttcaagcattatagatgatcctctttttactactgaactaatgaagcctttttcattgcattgttctgcatttatttctacagggagaaaactggttgtcctg

SEQ ID NO: 31487 - DNA, 360 bp, Homo sapiens
  misc_feature 8, 31, 32: n = A,T,C or G
gggtaccngaagtgagacataatggaatctnncttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctat

SEQ ID NO: 31488 - DNA, 395 bp, Homo sapiens
  misc_feature 30, 32: n = A,T,C or G
gctggggtaatatttcaggaagaagcacantntgcctctgctgcataaaagtttcacatgggaagcagagagtagcaggtggctgtaagctccattcagctcccatgtacttgacaagacaggtctcacacaacagtgttctgctagcagcagctacttgggttccaggcagccttcactcagaagtcaaaactgccccaggccataagctttttaaccaagacagaaaccatagatttcaagccacacttctcacaagctacccatgaatcagaaaacatacaagccagaggagattaggggcctatattcaacataattaaagaaaaaatattggaaccaagaattttatatccagccaaaccaagcttcgataagaagaaataacatcctat

SEQ ID NO: 31489 - DNA, 115 bp, Homo sapiens
  misc_feature 7: n = A,T,C or G
aaaggcnagagaggaaaaggtaaatgttaattgatttttataaatgaaagttatttttgaaccgtaaaaatgaagactgcactccagcctgggagactgagtgagactccatccc

SEQ ID NO: 31490 - DNA, 319 bp, Homo sapiens
  misc_feature 9, 12, 109, 112, 130, 149, 155, 168, 182, 190, 221, 223,232, 264: n = A,T,C or G
aaaggggcnaangacttatgatatcaaagcagagggaaatattagattccggtatatcgtatctgtcaagacacttgctctaagcggaatggaacatgtgggcgagacngtntttgaatatagaacacanaatgtggcacgcttgcccntcatanatcttgctcctgnggatgttggcggcncagaccangaattcggcgttgaaattgggccagttagtntngtgtaaagnaagccaagacacatcgacaatgagcaccaccntcaatgaccaccgccattcacaagaactttgactgtttgaagttgatcctgagac

SEQ ID NO: 31491 - DNA, 350 bp, Homo sapiens
  misc_feature 31: n = A,T,C or G
ggagtgcccactgtcctttacctgtatcccnaggctccttctctgagacttcccagctctcctgttatttcccacctcatgcttttctttgcagctgaaccttattcacagtgaaatcagtaatttagccggctttgaggtggaggccataatcaatcctaccaatgctgacattgaccttaaagatgacctaggtaattggggacggggttcggcaccaccagctgtcagatgaaaagttatggaacccagaatttaggcatttcatcttcccagactttacagtggtcaagccaaatttccaaatccaagattgatatttgagtgtagacgctgaatatcaacttact

SEQ ID NO: 31492 - DNA, 376 bp, Homo sapiens
  misc_feature 31: n = A,T,C or G
gtattcctccttacatagaaccttgtgcaanatgtctaagtaaagtaacaagttactatacagctaattcctcctcattagagtatcagatgttcttatttaattttctgacaaaaatatgaatgctgcaatttcattggtgcttaaggcctatattccagaactttcttcattgagttttagagaaagagaaatatattccttctgaagttgagggtcctgattttctgttaacaatgggccctatgatgctgcttccaactgagcaaggctaggaagaacttcacagctggctgggcacctgacatgcccaaggcaggtactctgacctgctcatatagccctggttcctcctggggagaatagcagtttccat

SEQ ID NO: 31493 - DNA, 383 bp, Homo sapiens
  misc_feature 18: n = A,T,C or G
tatggccgggcatgctcncttgagttgcttcatggtttatgctcgccatggaaagctatcagtaacagtttcatgcttataccgaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtat

SEQ ID NO: 31494 - DNA, 328 bp, Homo sapiens
  misc_feature 31, 296: n = A,T,C or G
attttagaaaattgatcagtaacatgttgcntgtggcttactctggatatatctaagcccttctgcacatctaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccanaaacattttcttttattgttacttgcttttta

SEQ ID NO: 31495 - DNA, 211 bp, Homo sapiens
tggacttcaagaccagcctggcgaacatggtgaaaccccgtctctactaaaatgcaaaaaattagccgggcacggtggtgcacccctgtagtcccagctactggggaggctgaggcaggataatcactcagacctggaaggtggaggttgcagtcagctgagatcgcgccactgcactccagcctggacgacagagtagggctccgtctca

SEQ ID NO: 31496 - DNA, 436 bp, Homo sapiens
  misc_feature 5, 30, 31, 32: n = A,T,C or G
gcttnctggtcaaaatggctggtaagcagnnngtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaaga

SEQ ID NO: 31497 - DNA, 109 bp, Homo sapiens
  misc_feature 3, 11, 20, 22, 29, 33, 42, 46, 57, 61, 78, 96, 97, 100: n = A,T,C or G
cangtgggtgnaggggggangnagggggnaggnggggggggnaggnagaggcggtgnggangggggagggggccagangcagcggagaacaaaggnnggnctgggacag

SEQ ID NO: 31498 - DNA, 111 bp, Homo sapiens
  misc_feature 1, 4: n = A,T,C or G
ntancggggacatgagttctttgctgacctccctagcggaagaaagcaaaattccttgcagttatgcaataggctttaggaaaaaaagactgcaaccaacggaaatcaata

SEQ ID NO: 31499 - DNA, 112 bp, Homo sapiens
  misc_feature 26, 51: n = A,T,C or G
tgattaactttgcttactactttgtngaaatgtggagaatgctgaataggnaaacatgatgacttgaagtgaccttttgtttgtttgtttgcctaaagttcccaaatatata

SEQ ID NO: 31500 - DNA, 477 bp, Homo sapiens
  misc_feature 7, 31: n = A,T,C or G
ggagtgnttgcagaaactggccttccatctntctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagag

SEQ ID NO: 31501 - DNA, 265 bp, Homo sapiens
  misc_feature 24: n = A,T,C or G
tggtgcacacctgtggtcctagtngtttgggaggctgaggtgaaagaatcacttgtgctcaggaggttgaggctgcagtgagctgtgatcacactactgcactcctgcctgggtgacagagtaagatcctaactgaaaaagtaatgtaaaaagccaggcatgtgactcatgccttaatctcagtactttgagaggccaaggtgggaagattgcttgaagtcagcagtttgagaccagcctgggcaacatagcgagacccctgtct

SEQ ID NO: 31502 - DNA, 344 bp, Homo sapiens
  misc_feature 31, 33: n = A,T,C or G
gctttccggcggtgacgacctacgcacacgntnacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggct

SEQ ID NO: 31503 - DNA, 411 bp, Homo sapiens
  misc_feature 6, 32: n = A,T,C or G
gaggcntctgaggcagccagcgcaggggcttnttgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttta

SEQ ID NO: 31504 - DNA, 203 bp, Homo sapiens
ctaaattatcacatgaatcctgaaagtatgtgtatctgttatgcatcaattaaaaattaaaaagaacttttaaaagtgcagcaactcaaattaggaattaaacaggagggtttaatagtattcttagctgaagaaaaaattagtaaactagaagatagatcagaagacaatatccataccaaagcacagagagacaaaaggat

SEQ ID NO: 31505 - DNA, 328 bp, Homo sapiens
  misc_feature 23: n = A,T,C or G
agcgtcgccgcgatggtgttgtnggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaaga

SEQ ID NO: 31506 - DNA, 337 bp, Homo sapiens
cttggtacactgtttcttagaaaaacgtaatagaaaggttttgttgggttttttttgtttgtttcatagcgattaaaaaaagtaaatctcctgtgtagaaaatgtaattatgtctacagtctgccagagtgattacttaagacttgtcataatgattagttcttctcgttttatttactcaatgcaacttttaaaaatacttactaccttcttacagatggttaatagtgaaagattcctttttattgtatatgaaaccagacagcggtgccattgccttcgtcctgctggtagacaaagaattcaaaattaaggtggggaagaagcagacagaaac

SEQ ID NO: 31507 - DNA, 425 bp, Homo sapiens
  misc_feature 15: n = A,T,C or G
tacaccggacctagnagtacctataggacataaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttg

SEQ ID NO: 31508 - DNA, 280 bp, Homo sapiens
gcttcagctaaccgtgtctctagcagccacactactctgagggctgactacagaatccagcagcttttgtctgggagagctggactgaagagaggcatagctggagacccatagctggccctggccagaaacagggagagtgaaaggctggaatagccaaggccagagcaaggctaataggtagagcaacagcttacaggtgtgggggtggcagatactggcacccttgaaatggattcctcatgcccacgcttcactattcttctctgtggctagggga

SEQ ID NO: 31509 - DNA, 338 bp, Homo sapiens
  misc_feature 24: n = A,T,C or G
acatcgagcagatttttaggtctntcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaac

SEQ ID NO: 31510 - DNA, 347 bp, Homo sapiens
tctagtctcagagattacatctgtcgtcagcacaatgattcccttccaagcccagtggtgcccagttgcctccaggtcccagacctttatgtggacaagaaaagcttacagaggaaatggtaattctccacttgcacactgaggtgtccagttgcagcccatggagatccagttcaattatgaatctcaggaacaccaccttctgtcagatggtgagaacaagaccaagattggaaagccagcttcagaggagggaattacagcaaaaattgaaccattgacagaagagtctagcagtctcagaatgttctccaggattctgaaggcaaagaattctgtgaatttgg

SEQ ID NO: 31511 - DNA, 258 bp, Homo sapiens
aacattgttctgaataaacttgccaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttctttc

SEQ ID NO: 31512 - DNA, 399 bp, Homo sapiens
  misc_feature 29, 55: n = A,T,C or G
atgtccatatgtgtgactaataaggcttntcatgattaacataatccaggtatgncatttctgaagagaatagtcatcaaatttatatctcgaagattttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtg

SEQ ID NO: 31513 - DNA, 389 bp, Homo sapiens
cctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaac

SEQ ID NO: 31514 - DNA, 379 bp, Homo sapiens
  misc_feature 32, 379: n = A,T,C or G
ggcgagccaggagttgagagaacggagcggtntccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagcagatgcgtatctgtacaaacagatcctactgatgaaattcccactaaaaagtcaaagaagcataaaaagcacan

SEQ ID NO: 31515 - DNA, 387 bp, Homo sapiens
gtggagggatattccctccaccaccagatgatgacatttatgatgggattgaagaggaagatgctgatgatggctccacactacaggttcaagagaagagtaatacgtggtcctgggggattttgaagatgttaaagggaaaagatgacagaaagaaaagtatacgagagaaacctaaagtctctgactcagacaataatgaaggttcatctttccctgctcctcctaaacaattggacatgggagatgaagtttacgatgatgtggatacctctgatttccctgtttcatcagcagagatgagtcaaggaactaattttggaaaagctaagacagaagaaaaggaccttaagaagctaaaaaagcaggaaaaagaagaaaaagact

SEQ ID NO: 31516 - DNA, 194 bp, Homo sapiens
gctgagggggcaggcggagcttgaggaaaccgcagataagttttttcctctttgaaagatagagattaatacaactacttaaaaaatatagtcaataggttactaagatattgcttagcgttaagtttttaacgtaattttaatagcttaagattttaagagaaaatatgaagacttagaagagtagcatgagg

SEQ ID NO: 31517 - DNA, 255 bp, Homo sapiens
  misc_feature 22: n = A,T,C or G
cttgtggaatataagggggtantgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgtttt

SEQ ID NO: 31518 - DNA, 355 bp, Homo sapiens
cttgtgggctagaagaatcctgcccaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagc

SEQ ID NO: 31519 - DNA, 256 bp, Homo sapiens
  misc_feature 240, 254: n = A,T,C or G
aggtgaaaaggagaaccccatgcgggaacttcgcatccgcaaactctgtctcaacatctgtgttggggagagtggagacagactgacgcgagcagccaaggtgttggagcagctcacagggcagaccccttgtgttttccaaagctagatacactgtcagatcctttggcatccggagaaatgaaaagattgctgtccactgcacagttcgaggggccaaggcaaaaaaaaatcttgganaagggtctaaaggngc

SEQ ID NO: 31520 - DNA, 251 bp, Homo sapiens
  misc_feature 7: n = A,T,C or G
gggcacncactgttatcgagtaccggtcactttaagacctcacgcctccccatcattgacattgcacccatggacataggagggcccgagcaggaattcggtgtggacatagggccggtctgcttcttgtaaaaacctgaacccagaaacaacacaatccggttgcaaacccaaaggacccaagtactttccaatctcagtcactctaggactctgcactgaatggctgacctgacctgatggtccattca

SEQ ID NO: 31521 - DNA, 383 bp, Homo sapiens
  misc_feature 10, 20, 29, 30, 359: n = A,T,C or G
ctctcacacncagtgcaatnaaattaganntcaagattaagaaactcactcaaaaccacacaactacatggatattgaacaacgtgctcctgagtgacttctgggtaaataataaaattaaggcagaaatcaagaagctctttgaaaccaatgagaacaaagagacaatgtaccagaatctctgggaggcaactaaagcagtgttaagaggtaaatttatagcactaaatgcccacatcataaagctagacatatctcaaattgacaccctaacatcacaactaaaagaactagagaagcaagagcaaacaaatccaaaagttagcagaagagaaaaaaaaaatgactaagatcaaagnggaactgaaggagacagagacatg

SEQ ID NO: 31522 - DNA, 306 bp, Homo sapiens
tactgtatctataagtctcatgtctgaaattacctaagagaacgatttaaaattgagtataaactgtgttttgacctgtcaaaccatagaacagctggaaatcatcaaccatgctgaactgatcacatgatcttcgtgacacatatagtataagagaaaccaggtactgaaagagaaacctagaaaacacatctggattttgaaaacatggtgtttgtttagtgtttagaacagtatgacatataaataagttgcacatagtagggtgatgttaattatgtttattttcatttttagatcaaattc

SEQ ID NO: 31523 - DNA, 356 bp, Homo sapiens
atagccatgaattcttgatgtgattgttataggcaactggcttttcctttgggttttgcattcaagttaattcatttggacttggaggtaatagagctcttgtctttatagaactgcctagaaatcttgtgtaggcacggagggcttgagccagaaaggagagacaagtgcaatcggactgtgcatgatgttgccactgatgactgcaagcatttgctggagaatctgaatactcttaaaatacccttaaggatttcagtgggtgagattgaaccaagcaactatggttctgatgacttggaatgtgaaaacacaatatgtgctttaaatatccgcaaacagacatcatgggatga

SEQ ID NO: 31524 - DNA, 407 bp, Homo sapiens
  misc_feature 6, 7, 34: n = A,T,C or G
ataccnngacttttaaaaaataaaacaaaatctnatttatcttatgactatgtaattttcactagaatctacacttctcagagcagccaggactttggaaactatgaaatgtcactgacatttatcatcaaatacaagcataaaatgtaagaactaaaaaatactcaaaagaaataactgcttagccctagcttctgagctaggaggatttgggctgtggaaacagggagggccagcaacctgtcccagcacaaaagaaaatagactctgaggtagataactgatcatacacagctgaccagacaagtacacagttttggaaggcaactttaatttaccattgcttttaagacatatgcaattgccttaataaaagagctttaataacagtgtattatctttatatg

SEQ ID NO: 31525 - DNA, 271 bp, Homo sapiens
cagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactag

SEQ ID NO: 31526 - DNA, 304 bp, Homo sapiens
  misc_feature 9: n = A,T,C or G
atattaaantttattcatcttggccgggctttttggctcacgcctgtaatcccagccctttgggagatcgaggcgggtggatcacctgaggtcgggagttcgagaccagcttggccagcatggtgaaaccccatctctactaaaaataacaaaaattagctgggcgttgtggcagacacctatagtcccagctatatggaaggctggggcaggagaatcgcttggacctggggggcggaggttgcagtgggctgagattgcgccattgcaccccagcctgggcaacgagtgaaactccatctca

SEQ ID NO: 31527 - DNA, 213 bp, Homo sapiens
  misc_feature 26: n = A,T,C or G
atgaaattgctataaaatcctagccngtattttttgcagaaatagaaaaatctatcctaaaattcatgtgaatgcatggggctccaagttgtccaaacaatccaaaaaaagaacaaagttgaagaacttgagctaatctgaggctgaggtggaaaaccacttgaacccaggagtatgactccagcctgagcaacacagtgagatcctgtctcc

SEQ ID NO: 31528 - DNA, 303 bp, Homo sapiens
accggatcaacttcgacaaataccacccaggctactttgggaaagttggtatgaagcattaccacttaaagaggaaccagagcttctgcccaactgtcaaccttgacaaattgtggactttggtcagtggacagacacgggtgaatgctgctaaaaacaagactggggctgctcccatcattgatgtggtgcgatcgggctactataaagttctgggaaagggaaagctcccaaagcagcctgtcatcgtgaaggccaaattcttcagcagaagagctgaggagaagattaagagtgttgggg

SEQ ID NO: 31529 - DNA, 152 bp, Homo sapiens
  misc_feature 24, 104, 114, 133: n = A,T,C or G
tcaaagattggtgggaaaaaaaanagattgatgggaaaggatgtagttagggaatggcctaagatgcaagggaaaaagaaatagttgaagcagtagcattctanattaaactgngggagggaaagagtaggancaagtagaagggttaatct

SEQ ID NO: 31530 - DNA, 473 bp, Homo sapiens
  misc_feature 7, 35, 60: n = A,T,C or G
gaaggancctaacagtcaaaattaagtgtgatttngagaagaacctgctgcatgtcacanacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatgtatggagcagcaagact

SEQ ID NO: 31531 - DNA, 363 bp, Homo sapiens
  misc_feature 11, 33, 35: n = A,T,C or G
gaagtgccagnatccgctgctgctgaggagagntncgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataat

SEQ ID NO: 31532 - DNA, 114 bp, Homo sapiens
gattccgctacgaccaactcatacacctcctatgaaaaaacttcctaccactcaccctagcattacttatatgatatgtctccatacccattacaatctccagcattccccctc

SEQ ID NO: 31533 - DNA, 368 bp, Homo sapiens
  misc_feature 27, 48, 50: n = A,T,C or G
ctttccttaagggtttagatttttaangttctattcagttacaaactncncctaaaatgagagggtttttttgtttaactgaaagagctggagagtaattaaaggtaattggcatgttattattcttaaaaggttcgcttttctgttctaagaataccagggaacaattgaatagataaaaagcaaactataaattgccaaatagatcttttgtataataatacatctcccaagacaaaagatatttcagacccataaaaaataagggaagtgtatttgcctgactggtcttgcatcttgcctgaccacaatgaatttgcatcagattttaaactcacagagttataaaatatcttaatgtgttaaga

SEQ ID NO: 31534 - DNA, 192 bp, Homo sapiens
  misc_feature 24: n = A,T,C or G
agaatcgaaagcatttgccaagantgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttgc

SEQ ID NO: 31535 - DNA, 290 bp, Homo sapiens
aaccagggctgcattggaggttgaaatcacaaagattagacacctttttagataggtgttcttcagcaccactgacaacacggttctgacagtatttcatgacagttatgtaacatttgtcctgcaagctgaggacagagaccttgtctgttgttgacagctacgtgaccagcacatagcatgaacctgatggatggtgacagttctacaacagatgcttctcaactaggaatctctgcagactatattggaggaagtcattatgttatacagcctcatgatgatactga

SEQ ID NO: 31536 - DNA, 258 bp, Homo sapiens
  misc_feature 28: n = A,T,C or G
aacatagaactgccaactagaaagtacnacaggctcgtgatctggtgacctgagcgactctgaatgcttgctgagtcctagttggccatctaggttggttcccatgtttgagagacgaggatggatgaatttaaggtaagcaatatatgccatagctatacgtgctctgtgcttactggtttgagggcttttctgtgtttttgtatgtgtgaagatgagaaaaactatcaacactacctctgttgtgtcttgtcaatt

SEQ ID NO: 31537 - DNA, 310 bp, Homo sapiens
taacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttc

SEQ ID NO: 31538 - DNA, 365 bp, Homo sapiens
gttagtattccctgttctctatgtcattagaaactcttcagcatgaagattccactaatttcaaccagaatcgagtggataaaagagatgagtaacgtgagaaaatgaaatgaggagattggcactcagtgggggaagttagggactccaaggagaaaaataaaagctgtcttcatcaactggcccaagacagtggggggagtttattaaatgtgattctttccagcactctattctaaatctctcctacattacataaatcagagtcagaaatatttgggtttgaattctatttctgacatctatcagatggggtgacttcttacaaactccaacagcctcagtttcctcattggtaaaataga

SEQ ID NO: 31539 - DNA, 395 bp, Homo sapiens
  misc_feature 31: n = A,T,C or G
caaactccctgacctcaggtgatccacccgntttggcctcccgaagtgccgggattacaggcatgagccacagtgccctcccttgtctggtgttttgtcatgttgtagccagctctctgtattaaatcccctctgagtatctagtagtttttgttgattggtagaaatagcatggtcaggaatgccaggtactgcagaaagatggaagggatggaaatggaaaatggtcagatctttgagcaatggggtagagcccagaattccagggcttgagaaggggatttctgccaaaccgatgggtgtataccaattctcatgaaggtcttaatttggacctactttgagactgcatactttttcatatttatcagacagctgggtacagtctgtttttg

SEQ ID NO: 31540 - DNA, 335 bp, Homo sapiens
cactaaggtcttcggcaatggggctgacctctccggggtcacagaggaggcacccctgaagctctccaaggccatgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagc

SEQ ID NO: 31541 - DNA, 337 bp, Homo sapiens
  misc_feature 8, 29, 57: n = A,T,C or G
ggattcgnctggctgggatgtggcagagnatttgcatttatttgtctgtgacctttncctgtttcagctgtgaatatgggtccccacgttgatctcagctagggagctgggtattaaccatcaaggcagtggtgaaccgggtgggcctcccacacaaaaagctcactggcaactagcaaatccagatggcgcacatatccatgtgatattagccacatagaggcctttgcggggcttttttttggacattgctaagcctgctgagtctaagatttcaaatgctgttttgagctacttgatttagaggtgaagccagaccacttggagggaagtgtga

SEQ ID NO: 31542 - DNA, 359 bp, Homo sapiens
taaaggaaagaagaaaaagggccacaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccat

SEQ ID NO: 31543 - DNA, 195 bp, Homo sapiens
  misc_feature 180: n = A,T,C or G
acgtgtatacctatgtaacaaacctgcacgttctgcacaagtatcccagaacttgaagtataataataaaaataaaaacggccaggcgtggtggcacacgcctgtaatcccagcactttgggaggccgaggcagacagatcacgaggtcaggagatcgagaccatcctggctaacacagnaaaaccccctctcta

SEQ ID NO: 31544 - DNA, 221 bp, Homo sapiens
cagagacccatcttcaatactttgaactcattctggtaaacttccttctacctatgtgcaggtccctgtactccagccaacacaggctcagtaactggaaatgaattggctaaaatggtagcaccattgggtttcttaatggagctttaggagttctttatggaaaaaagcacagaactaaattcctcaaaaaacaaacaaacaaacaaaaccacacacgc

SEQ ID NO: 31545 - DNA, 354 bp, Homo sapiens
aagatacacaatttaagataatatctttaattttattttttatttgttaaataaatttttctcctttcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttaga

SEQ ID NO: 31546 - DNA, 385 bp, Homo sapiens
  misc_feature 29, 31: n = A,T,C or G
gcgtgcgggcaggcggagcttgaggaaantncagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgta

SEQ ID NO: 31547 - DNA, 110 bp, Homo sapiens
  misc_feature 24, 26, 57: n = A,T,C or G
ctacaattatgggaaatgcaaaancngtttggatatggtagtgtgtggttctctttnggaatttttttcaggtgatttaataataatttaaaactactatagaaactgca

SEQ ID NO: 31548 - DNA, 345 bp, Homo sapiens
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatg

SEQ ID NO: 31549 - DNA, 317 bp, Homo sapiens
  misc_feature 26: n = A,T,C or G
aaaagaaaagtgtaatgcaagaattnaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcgacaataaaaac

SEQ ID NO: 31550 - DNA, 332 bp, Homo sapiens
  misc_feature 1: n = A,T,C or G
ngccccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactg

SEQ ID NO: 31551 - DNA, 147 bp, Homo sapiens
catttgaacctagcaagcagaggttgcagtgagccgagattgcactactgttctccagcctgggcaacagagcaagactccatctcaaaaacaacagcaaaactgctgtttaactccacaaaagtcattacaccactatacattcac

SEQ ID NO: 31552 - DNA, 326 bp, Homo sapiens
actcccactaccacacaaatcctgacaggtatcctttctgcccctctagggaaggggcccgtgtgaggaactcttactggacgcccccttccctgttgctgtgctgatcttacacatcagtttccacggatcccatgtgaatcagctgtcttcctcatttactctgagcaagggtggcagcagcaatagcagaagacgtagatgcagtgactcattttgcatgatgtctgcaagagagccgggcctcccgtgtgctgtggctctcgttcaggcattgcttcagaaacttgattcttctggaattgtgcataagagggccttttaga

SEQ ID NO: 31553 - DNA, 308 bp, Homo sapiens
tgggaagaagagcactgaacaaaacttgcttttatcatgtgctattttatcaagggggtgaccttagttcttatctcacagagaaaagagaagctattcgattagaatgtccacagccttccatctgtaccgacatagtctgacttccctacccttactcttaattaaaccatccatctctctgcccactggatccctttctccaggacacactcttgccactgacctcctttgtttcctgcttaaacaatatttccttctctactgggttattcctgtcagcatacaaaatatttcaataattcata

SEQ ID NO: 31554 - DNA, 398 bp, Homo sapiens
cttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcaga

SEQ ID NO: 31555 - DNA, 364 bp, Homo sapiens
cttgacctttcttgacctaaaaaatgttttacatatatatgtatgttagtgaaacctgaacttcaggggtacttggaggcttcagttggaaatgaatctcagatttgtttttaacaaaggtcttaaattagttaattgtgtaagaatttacagcaaagctaggagtaacatactccaacctttgttttgtaattcatgttgtcttaaatatgaattataagattatttactctctcattggaactttagatagcagtgattatcttatttttcagtcattcaaaattttgaactttaatttctctcttacccatataaataccagcaatgttcccaatgtgaagagacaggatacattaattac

SEQ ID NO: 31556 - DNA, 342 bp, Homo sapiens
gactttatgctagaaagaatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaaga

SEQ ID NO: 31557 - DNA, 288 bp, Homo sapiens
gctctgtttcaagaatttttttttccagataatcaaattattttgattattttataaaagggatgatctatgaaatctgtgtaggttttaaatattttaaaaattataatacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttgatg

SEQ ID NO: 31558 - DNA, 341 bp, Homo sapiens
  misc_feature 7, 29: n = A,T,C or G
caaacantttcattttggatattctcctntttttattaaaccagtgattacacctggccatccctctaaatgttctaggaaggcatgtctattgtgattttgatgaagacagaattatttttctctgtagaaacacagataccactttatcagggaagttagtcaaatgagatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatgga

SEQ ID NO: 31559 - DNA, 354 bp, Homo sapiens
  misc_feature 6: n = A,T,C or G
gatggngctgcagacttaccgttaccacggtcacagtatgagtgaccctggagtcagttaccgtacacgagaaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcggtggatcaagtttaagtcagtcagttaaggggaggagaaggagaggttat

SEQ ID NO: 31560 - DNA, 411 bp, Homo sapiens
  misc_feature 7, 32: n = A,T,C or G
cagaccnaactcgacagatactagaaaaagtnttgaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaacttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctct

SEQ ID NO: 31561 - DNA, 270 bp, Homo sapiens
  misc_feature 5: n = A,T,C or G
ctccngggttcaggtgattctcttgcctctgcctcccgggttgctgggattgcaggcatgtgccaccatgcccagctaatttttgtgtttttggtgaagccctgtctctgctgaggatacagaaattggctgggcatggtggcgtgagcctgtggtcctagctactcgggaggctgaggcaggagaatagcctggacctgggaatcggaggttgcggggccaggatcgccccactgcactccagcctggcaatagaccgagactccgtct

SEQ ID NO: 31562 - DNA, 400 bp, Homo sapiens
  misc_feature 7, 31: n = A,T,C or G
gcggccnaggcagccatctcgccgtgagatntcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcgggttttcatggagactgtcttacgctgacaaagattattgaagcaagactaaagatgtataagcattccaataataaggccatgact

SEQ ID NO: 31563 - DNA, 284 bp, Homo sapiens
aggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttg

SEQ ID NO: 31564 - DNA, 319 bp, Homo sapiens
  misc_feature 177, 268, 294, 309, 318: n = A,T,C or G
aaactatgtatggtaaaggaccacgttttttgttttccagtccttcacttatcaatatgcattcctattgccgatgacaggtatggagttcacactgtgtgctgccgacccggcaagtttgacagcacccaaactggccagactgttctgtaggttaagtccattgatcatgtactnggatatcacagcaacattgaaatgctaaaaagtttttaaacactctcaatttctaattcaccatgtcacagactggtgaaaaaaaaaaggngttcactgaccagcacaagtctgcanatcatctttgagtancactgtttng

SEQ ID NO: 31565 - DNA, 321 bp, Homo sapiens
  misc_feature 24: n = A,T,C or G
aggggaagaggcctgtttcgctgncgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactgga

SEQ ID NO: 31566 - DNA, 239 bp, Homo sapiens
  misc_feature 23, 230, 238: n = A,T,C or G
tgctgtccacggaaggctcccanaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaanacctcacnc

SEQ ID NO: 31567 - DNA, 255 bp, Homo sapiens
  misc_feature 25: n = A,T,C or G
gatgttttgatagttgtaaggaaanaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgttttttttttggttttt

SEQ ID NO: 31568 - DNA, 311 bp, Homo sapiens
  misc_feature 4, 9, 33, 60, 288: n = A,T,C or G
gacnaccanccacaggggattctccaagaactntttactgtgactgggaatccattaatntcctcttcagcagctggaaaaggggaattctgtactttatttggtgtttaagattgctagactgtaaattctcatcacaaggatggacttgtctcaattgcgatgcaagggaatttgtgccaaaggagttaaaaagaaccatccctgtgtcccgggatcgttgccctcagaactgaaattagataaagcaagggacttagaaactgttctgcccttttgagagaaganaaaaatggttctgtatctttgga

SEQ ID NO: 31569 - DNA, 176 bp, Homo sapiens
  misc_feature 20: n = A,T,C or G
aatacttttttattttgttncattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacctt

SEQ ID NO: 31570 - DNA, 158 bp, Homo sapiens
  misc_feature 25: n = A,T,C or G
attgttagggacaccatgtccgtgntttaaatgtttattaaaattgcgttgtattttaatctcaacaatatcaatatagatttatcctcagtcatgtgtatcaacttttgtgaaaattaattttattttctttcactggcataagtttaatagttatt

SEQ ID NO: 31571 - DNA, 219 bp, Homo sapiens
  misc_feature 24: n = A,T,C or G
caattgttgacttttctgttaganaatagggaaccttcgtatttaaataactttatagcaagtattgaatgtcaaaggttaacttcaaatagcaaatgctttttagtgttcctctacccaatgtaaaacaacaaaattaaccaacttccagagcagtataagaattctaaaagcatcattacacccccctggctttacattttacactccatatactgc

SEQ ID NO: 31572 - DNA, 328 bp, Homo sapiens
gaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgcttgggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttg

SEQ ID NO: 31573 - DNA, 298 bp, Homo sapiens
  misc_feature 16, 24, 178: n = A,T,C or G
cttcgctcgtactcgngcgcctcncttcgcttttcctccgcaaccatgtccgacaaacccgatatggctgagatcgagaaattcgataagtcgaaactgaagaagacagagacgcaagagaaaaatccactgccttccaaagaaacgattgaacaggagaagcaagcaggcgaatcgnaatgaggcgtgcgccgccaatatgcactgtacattccacaagcattgccttcttattttacttcttttagctgtttaactttgtaagatgcaaagaggttggatcaagtttaaatgactg

SEQ ID NO: 31574 - DNA, 277 bp, Homo sapiens
  misc_feature 2, 179, 180, 226, 269: n = A,T,C or G
gnataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagcnncctaagaacagctaaaagagcacacccgtctatgtagcaaaatagngggaagatttataggtagaggcgacaaacctaccgagcctggngatagctg

SEQ ID NO: 31575 - DNA, 138 bp, Homo sapiens
  misc_feature 21: n = A,T,C or G
atttggtaaattatgaactgnccgtaaatttgtacagttcatgtatattgattgtggcaaagttgtacagatttctatattttggatgagaaatttttcttctctctataataaatcgtttcttatcttggcatttta

SEQ ID NO: 31576 - DNA, 143 bp, Homo sapiens
gaagtatttttagaataagaattcgcatacttacctagtgaaacttttctagaattatttttcactctaagtcatgtatgtttctctttgattatttgcatgttatgtttaataagctactagcaaaataaaacatagcaaat

SEQ ID NO: 31577 - DNA, 269 bp, Homo sapiens
  misc_feature 24, 263: n = A,T,C or G
gatatgaccgctgtgatgcgggcnggttggcggatggcagcgtccgctaccccatctctaggccaagaaggcgctgcagtcctactgaggctgcagtgcgcttcgtgggtttcccagataaaaagcataagctgtatggtgtctactgcttcagagcatacaactgaatgtgcccttagagcgcatcagttttaaagtcattaagaacatgtgaaaggtgttttttttttccaatatgaactcatgcaagttaccaaaactgngataac

SEQ ID NO: 31578 - DNA, 316 bp, Homo sapiens
gtaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttat

SEQ ID NO: 31579 - DNA, 297 bp, Homo sapiens
  misc_feature 7, 31, 36, 57, 293, 297: n = A,T,C or G
aacatcncgatctatcaatcttttatgcttnttggnctttccttcattctttgacancctctccctactccaagatttaaaaatgtttacttttgtatttaaagttttgatcaatctggaattttttttgttatgagaggatctatcttcacttttttctaagatggctacccattcatcttttccctactgagaaacaatatcgtattctaaattctcatatgtctttgtgtcatatttgggcttcctcttctttttcattgatttgcctattcttgtttttattttatttnattn

SEQ ID NO: 31580 - DNA, 160 bp, Homo sapiens
  misc_feature 25: n = A,T,C or G
gagtcagcctctggttcagactgcngtaaccactattcctgcaccaactgacctgaagttcactcaggtcacacccacaagcctgagcgcccagtggacaccacccaatgttcagctcactggatatcgagtgcgggtgacccccaaggagaagaccgga

SEQ ID NO: 31581 - DNA, 252 bp, Homo sapiens
  misc_feature 23, 242: n = A,T,C or G
tatctgggaggtgttgggcgcgnccagtcgagatgtcagagaaaaagcaaccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacgtggttataagatggagacttcntagcatccag

SEQ ID NO: 31582 - DNA, 231 bp, Homo sapiens
  misc_feature 25: n = A,T,C or G
gttctgtcagaatgttcttttgtangcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactac

SEQ ID NO: 31583 - DNA, 184 bp, Homo sapiens
agtgacccaataaatcagtgattgccaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctct

SEQ ID NO: 31584 - DNA, 138 bp, Homo sapiens
  misc_feature 18: n = A,T,C or G
gaagaatccagctgtttntgaaaatgacaaatgagcaacgcatccggatgacggttccctgtctctgaaagacctttctctggaagaggagtctgcattgtagtgtctcaaaggcacaataaacttcctatggtctgc

SEQ ID NO: 31585 - DNA, 424 bp, Homo sapiens
  misc_feature 30: n = A,T,C or G
aattccttaaggcaaatggactaaacactnctatcaaaggtagagactgccaagcctagataaaagcagggcacaaatatatgttgtttacatgtcctaaacataaggatacatattggttaggtgttaaatttgggggaaaaaatatgccgtgcaaatactcactgtagtaaagctagaatgactatattaatattagacagtagatttcagagcaaagaatactgtcagagataaacaggaatacttcataactgggtcaattaatcagaaatctataataattccaaataaacttacacctaataacagcttcaaaatacacaaagtgaaaatccgacagaactaaagaatgaagtagacaaatccgtaaatatgattagaaattgtaataccttttactcagtactttaaattatacaga

SEQ ID NO: 31586 - DNA, 410 bp, Homo sapiens
  misc_feature 24: n = A,T,C or G
gcaaagaagggtggcgagaagaanaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcctac

SEQ ID NO: 31587 - DNA, 323 bp, Homo sapiens
gacaccccttttcatctgtcccgctgcgttttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttt

SEQ ID NO: 31588 - DNA, 342 bp, Homo sapiens
  misc_feature 7, 28, 29: n = A,T,C or G
ggaaccntgccgggccccctgtatcctnntggtactgtgatttccaacaccatcccctgttctttgactgatgaaatcggcatatgataagggaccatggtcattggaaccatgattggaaaactataaacttgattctattgtctgtatcagaactggccttagaccttaaaccttaaaaccttcagtaaactctgctagaaaatagaaaaatgagttaatgcccaatcacagggcagttgcaatgatgtagggtatctgcttataaatatatgcccaaaatagtcctttttttgtgtcagaaggcaataaaaacaggattatataaaaaaagcacaggtg

SEQ ID NO: 31589 - DNA, 193 bp, Homo sapiens
  misc_feature 24: n = A,T,C or G
ctgagggggcaggcggagcttgangaaaccgcagataagtttttttctctttgaaagatagagattaatacaactacttaaaaaatatagtcaataggttactaagatattgcttagcattaagtttttaacgtaattttaatagcttaagattttaagagaaaatatgaagacttagaagagtagcatgagg

SEQ ID NO: 31590 - DNA, 406 bp, Homo sapiens
  misc_feature 22, 30, 31: n = A,T,C or G
ggcgactgagcggacaaacggnaagtgtannttttcggtctgagacatcaccgccaagcctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatat

SEQ ID NO: 31591 - DNA, 387 bp, Homo sapiens
  misc_feature 7: n = A,T,C or G
aaggacncagcctggaagatcctgggactattctatgagagaccagctattgccagcaacaaagacacctctactcaaataaactagaaaatctagaagaaatggataaattcttggatacatacatgctcccaagactaaaccaggaagaagttgaatccctggatagaacaataacaagtttggaaattgaggcagtaattaatagcctaccaaccagaaaagcccagtagcagatggattcatagccgaattctaccagacatgcaaagaggagatgctaccattcctgctgaaacgattccaaacaatagaaaaagagggactcctccctaactcactttatgatgccagcatcatcctgataccagaatctggcagagacac

SEQ ID NO: 31592 - DNA, 268 bp, Homo sapiens
cggtgttccgttattggaatgctaagcttgtgggagttctttatatcctactgcttaaggtcattgccagtgtcttctttttcacacacaaaaaaactgcaacctctggcataaatggattaagggttctagtctcaacctgcctcagaagtgatgtatgaatctggtctcatgtcttttaacctactcagcactcaagttttcttatttgttaaatacctataagtatagctatctacctatatctcatggagaaagggataagatc

SEQ ID NO: 31593 - DNA, 440 bp, Homo sapiens
  misc_feature 8, 9, 43, 52: n = A,T,C or G
agggaacnncggtttttatggccggaaagtaccagatctcagnaaataaatnacacttttgttatgatgacatttagatttgtctttgaaatatttatactattgcttccttttccccatatggtcatttcttatattgaatcttgataaaatccaagattataactttgtgtgaaacagtgtagggcatttttatctaaggacataagctaatgtccagatatattactttctggtgatgtaatatgatagcaagaactgaggaaggtgtgggtagtatcctgtgtgttagactgtcttcccaaacatgaaatgctacaagcctgacttgaccagaaaagcaggaaatcatttcaaggttggacttgctggcaaaaacctagagtatagtaattttgtactgctgattttaaagatgcgccccatgctttgatatatat

SEQ ID NO: 31594 - DNA, 403 bp, Homo sapiens
  misc_feature 7: n = A,T,C or G
atttgangtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggatatttaatgatttctttcagcgttaaaaagaaac

SEQ ID NO: 31595 - DNA, 241 bp, Homo sapiens
aggtcaaggcaggcggatcacgagatcaggagatcgagaccatgctggccaacacagtgaaaccccatctctaccaaaaaaatacaaaaaaattagctgggcctagtggcgggcgcctgtagtcccagccactagggaggctgaggcaggagaatggtgtgaacccgggaggtggagcttgcagtgaggccagatcgcaccattgcactccagcctgggcgacagagccaaactcgtcaca

SEQ ID NO: 31596 - DNA, 291 bp, Homo sapiens
  misc_feature 25: n = A,T,C or G
gctgtgctggctgcaagaatttcangccagtggatcttagcttgctgggttccttgggggtgggatccattgaggtagaccacttggctccctggcttcagccccgtttccaggggagtgaacggttctgtcttgctggcattccaggcaccactggggtatgaaaagaaacccctgaagctagctcgatgtctgcccaaacggctgcccagttttgtgcaggaaaccagggccctggtggcataggcaccagaaggaatctcctgttctgagggttgtgaagactgtggg

SEQ ID NO: 31597 - DNA, 283 bp, Homo sapiens
  misc_feature 6, 29, 30, 31: n = A,T,C or G
gctatntgaatatcatggagtgcacttannnttatctagatggtgtagcctacctcacacctaggctatacggcatagcctattgcttctaggctcaaacctgtacagcatgttactgtcctgaatactgtaggcaattgtaacacaatataagtatttgtgtttctaaacatatcaaaacatggaagaggtacagtaaaaataccgcattataatcttatgggaccactatgcagtccatcatggagggaagcatgcagttcatgacatgtgtgggtgtgtg

SEQ ID NO: 31598 - DNA, 380 bp, Homo sapiens
  misc_feature 5, 8, 30, 32, 37, 58: n = A,T,C or G
ctagnacngcagctcagcgcttctatggtntntcggnctcgagcagaagccccactgnagtgtcccctggcagacacccacatgaactcttccgagaaactccagttctataaagagaaagccccagattgccatgggccagtgttgaaacacgaagctatctcaagccaggagtcaaagaagagcaagaagagaccttttgaggagtcagagacagaacagaataactcttcacaaccttcaaagcagaaatatgtatgtcttgctgtggaagactgggacttgttaaattcctattgattagtagatacaagttgacctttctcgggcctccagctctagtgtttgagtaaaggagactgaggatgatttactttttg

SEQ ID NO: 31599 - DNA, 123 bp, Homo sapiens
  misc_feature 25, 88: n = A,T,C or G
tgaaatacaatttgtcattttttcnttctgtaggcttcttaattataatcaacttgaatttaaatctaaagagccacatgtgtctagnggctactgtattggacagcatgggtcagaggaaga

SEQ ID NO: 31600 - DNA, 107 bp, Homo sapiens
cgcaggcaactgtgtgtgtcctacacaatggtgctattctgtgtcaaacacctctgtattttttaaaacatcaattgatattaaaaatgaaaagattattggaaagt

SEQ ID NO: 31601 - DNA, 321 bp, Homo sapiens
attagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagaaattcctcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagc

SEQ ID NO: 31602 - DNA, 122 bp, Homo sapiens
  misc_feature 31: n = A,T,C or G
ggagacggacaagtcaactatgaagaattcntacagatgatgactgcaaaatgaagacctactttcaactcctttttcccccctctagaagaatcaaattgaatcttttacttacctcttgc

SEQ ID NO: 31603 - DNA, 427 bp, Homo sapiens
  misc_feature 34: n = A,T,C or G
atctctcaaactaaattgaccatgccatatattnttctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaat

SEQ ID NO: 31604 - DNA, 193 bp, Homo sapiens
  misc_feature 24, 189: n = A,T,C or G
gctgagggggcaggcggagcttgnggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcntgag

SEQ ID NO: 31605 - DNA, 172 bp, Homo sapiens
  misc_feature 23, 24, 159: n = A,T,C or G
gttgaagttaagttttccaatanngtgacttcttaaaagttttattaaaggggaggggcaaatattggcaattagttggcagtggcctgttacggttgggattggtggggtgggtttaggtaattgttagttatgattgcagataaactcatgccaganacctaaagtctag

SEQ ID NO: 31606 - DNA, 396 bp, Homo sapiens
  misc_feature 3, 5: n = A,T,C or G
ctncnattgcacctcagattcactcattttcaatcttctctgagaagcctacttccttattctcataaactaagctgagcagtaatcgtcctttgccttgatgggaagatctgctaattacccacagctctggagaaatgcaaatctgtggctatgtcatggatctgatctgccttctatgaccttaaccccccaccctaactccttctggctcggatttaaacaaattaactagacatgaaacagaaagaggctgttacttaagggaattggatcctcggagcatatactcctgaatttcccttatgggtttgagtcagcagtgatgtctcagagacattccagatgacttcaaggaggcaagggcagactggtaattaaaccacaccaatcagg

SEQ ID NO: 31607 - DNA, 320 bp, Homo sapiens
  misc_feature 19: n = A,T,C or G
atatgaggaaattgttaangaagcccgcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctca

SEQ ID NO: 31608 - DNA, 216 bp, Homo sapiens
ggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattga

SEQ ID NO: 31609 - DNA, 412 bp, Homo sapiens
  misc_feature 33: n = A,T,C or G
gaatcttagttcaactttaaatttgcccacagnaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacccaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgcc

SEQ ID NO: 31610 - DNA, 419 bp, Homo sapiens
agcgcccagtaattctggccccttttcctgcttccaaggttctgcttgtgcagtttcgcccatgagaaatgcacttattgcttctgtgttccctgcaaatacatacacccctgctttatccttggctctctgcttccttcttccctttcatgctgcctccaagttcactcacgccctccctgaagccctctctgaagctgccctccttgttcttaaaagcttccacatggctttgctaacatctttgttctgccctgggttggccaagtcaaataagtagaccctgggcaaaatccatggtctgtcaagcctcaatttccttaccaataaaatgggatggtaataatagaacccatatcccaggatgagtatgaagattaagagaatgggtgagaagccccagagcctggtgtgcagta

SEQ ID NO: 31611 - DNA, 485 bp, Homo sapiens
gtatactaatgttacggcttctatcttattaaatgagggcaaataaggctagaattaagacttgaagccaaaagatcttcatggctacaaagcccatattctttctaggcatgctacactgcttcccatggcacttattaccacttgatttattatctgtatgttacctcagaacccttgtgacataagattagagtacaattaaaatgattttcaacttggaataccaagtatcatatgatctccactctggctttctccaggtagtctctgttggatggaatataaccagaaaaataaatgttgggttagaaaaattgtcacaaggggctggccaggctctgtggctcacgcctgtaatcctggcactttgagaggccgaggcgtgtggctcacctgaggtcaagagttcgagaccggcctggccaacatggtgaatccctgtctctactaaaaatgcaaaaattggctgggcattggtggtg

SEQ ID NO: 31612 - DNA, 253 bp, Homo sapiens
  misc_feature 2: n = A,T,C or G
gnagaaattcaggtacgaaaccatcaatggacaacttgaaaatgcatgttcctcaggcctatgcagttcccagagactcttgacaccggtctctgctgaggctcccagcctcagtttcccccacagcagcacgggccccactgtgctgctcttcaggtccccacagccctgcctttggttcctggacatttggtattctgccctccactctggtactatcagagtagggcaggctctggattaaagcttttag

SEQ ID NO: 31613 - DNA, 119 bp, Homo sapiens
  misc_feature 36, 47: n = A,T,C or G
ttatggcccggggtgcccagggctgcatctgcaaanggacgtcaganaagtgcagctgctgtgccctgatgcccaggacagctgtgctctcagatgtaaatagagcaacctatataaac

SEQ ID NO: 31614 - DNA, 270 bp, Homo sapiens
ccccacacctgtaatcccagcactttgggagtctgaggcaggctgttcacctgtggtcaaaagttcaacaccagccgggtcaacatggtgaaaccccatctctactaaaaatacaacaattacacaggcatggtggcgggcacctctaatctcagctactctggtgactgagccaggagaatcactggaaagtaggagttgattcttgcagtgagccaagaccatgccatcacattgcagcatggacaacaagagtaaaatgttcaccca

SEQ ID NO: 31615 - DNA, 418 bp, Homo sapiens
  misc_feature 1: n = A,T,C or G
nagcttttgaatcctgacatttcttatgttaactctgcttcttttaaaatcttattggtcccatgactctcaatgaaaacaacttcatataacaaaatcaaactgtaatatatttcctcagttgaccgaaatgatttagtaatagatgatttggctattgtaatagtgtatatcctggaagtttctcagaataccttcttagtttcaacttttgttgacagatctttctgaaaagatccatgtacagtgttttaaaatctcctcaggatagacattctgagtaaggattcttatgtggtgtagataaattgtatcttctacatatacaaagtggctgggctcagaaattccttttctttgtttttgagacagggtcttgctctatcgcataggctggagtgcagttgggtaatcactg

SEQ ID NO: 31616 - DNA, 412 bp, Homo sapiens
  misc_feature 410: n = A,T,C or G
acttattgcaattggactatcctaattgaagaaattaaaaaatactctatcactctccacaagatgacagaggacaaatcaacaaattgaatagtgcaatgtgcattctgtcctgctttctttgatgtctgtaagaacaggattcaaaaattattttcatttctctcttaaactaatatggatatttaccatgataatattagatagaacctattctttgaaaatagagggctgggtcccttgagaatgcactttgtgagatccacccgctgcccccaaaacattgctcttaactccaccgcctatcccaaaacctataagaactaatgataatcccaccacccttgctgactcttttttcagactcagcccacctgcacccaggtgaaataaacagccatgttgctccnga

SEQ ID NO: 31617 - DNA, 247 bp, Homo sapiens
  misc_feature 3, 20, 26, 28, 43, 65: n = A,T,C or G
atnttttgtgccccgggaanctcggncntttatggcccgggangttagtataagtaacctgaaanattctcctccgcataagccctgcgtcagattaaaacactgaactgacaattaacagcccaatatctacaatcaacccaacaagtcattattacccccactgtcaacccaacacaggcatgctcataaggaaaggttaaaaaaagtaaaaggaactcggcaaatcttaccccgcctgtttacc

SEQ ID NO: 31618 - DNA, 392 bp, Homo sapiens
  misc_feature 3, 11, 30: n = A,T,C or G
gangctgtganctttggcctggccagaganatcatgcatgattcgaactatgtgtcgaaaggcagtaccctttctgcccgtgaagtggatggctcctgagagcatctttgacaacctctacaccacactgagtgatgtctggtcttatggcattctgctctgggagatcttttcccttggtggcaccccttaccccggcatgatggtggattctactttctacaataagatcaagagtgggtaccggatggccaagcctgaccacgctaccagtgaagtctacgagatcatggtgaaatgctggaacagtgagccggagaagagaccctccttttaccacctgagtgagattgtggagaatctgctgcctggacaatataaaaagagttagc

SEQ ID NO: 31619 - DNA, 226 bp, Homo sapiens
gaggcattgaggcagccagcgcaggggcttctgctgagggggcaggcggagcttgaggaaaccgcagataagtttttttctctttgaaagatagagattaatacaactacttaaaaaatatagccaataggttactaagatattgcttagcgttaagtttttaacgtaattttaatagcttaagattttaagagaaaatatgaagacttagaagagtagcatgagg

SEQ ID NO: 31620 - DNA, 290 bp, Homo sapiens
  misc_feature 4, 6, 205: n = A,T,C or G
agananggggctttcaccatgttagccggatggtatcaatctcctgacctcgtgatctgcccgcctcagcctcccaaagtgcaggaattgcaggtgtgagcgactgcgcccagcacaaacaaggattttttttttaacccaccaaaagtattgatctgttctcttttgccaagatctgtatgcaattatctctcacttttctggngtttacttatgtcacccacagctgtctggaatataggtaaaaactaaaaatgcaatccaaaaaggctcttaaacaatacagattt

SEQ ID NO: 31621 - DNA, 288 bp, Homo sapiens
gaggcattgaggtagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagt

SEQ ID NO: 31622 - DNA, 195 bp, Homo sapiens
  misc_feature 96: n = A,T,C or G
cattgtcaaaggaatgtgacatgggggctggtatacaggttcctctttaatttgaactttatatgctatctgaaattgattaaaacttttattaangtctttgtgttttttaaaggctaaactcaaaatgggatctccgaagactttgtaaaactgttggtgctacagctcttcctagattggtatgtattttgg

SEQ ID NO: 31623 - DNA, 498 bp, Homo sapiens
  misc_feature 1, 12, 31: n = A,T,C or G
ntggcccggganctgttgttgagtgtaagangtccttcatgttttcttataaagtcagtgtttagaaatgttaccctttctaagttatatacagatcaaatgcttttttctttcacgtacatccatcatttgcaactgctgttcgtacacagaaacaggactgctcaaatgatcctatttgtattttctgatgctatcagactctaatgtttttttccctaaaatattattgccatcatgctttaggaattttatatttttacacaatcatattttagtatggtgtctgtttatgtaactctgacttgctggaaaagttgaaactccaaataatctgaaactagaaaagaaatagcacataattactaccttccccttggcggctctcctccccaacccccaccccacaattttatgacttccatttggcaattgttgaattataactgcgactgaaacaaacaggttcatagagatgaattttctgagaaacatata

SEQ ID NO: 31624 - DNA, 341 bp, Homo sapiens
  misc_feature 2, 3: n = A,T,C or G
annccaatttttttatctttgtgccatgcgtgaatgaggtaggttatgtaaaacaaggacgaatgcacaagcgcctccagtcatacgctttcccatgacaacatgcacaatctattctttgtcaaatgtagagcaactcctgcagtacttgtatttcagaatttttctatggctcttagagcaaaatcacagacattttactttgtctttgtttccgccaaaaatttgtaaggcagagtaagattcccattcctctacatttttatacactaggattaggggtggacatgggtgattaatcaagaaaaaattctcatgtcttcttttgatcatcatctctg

SEQ ID NO: 31625 - DNA, 354 bp, Homo sapiens
tatggccgggggcctttccggcggtgacgacctacgcacacgagaaatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttcga

SEQ ID NO: 31626 - DNA, 445 bp, Homo sapiens
ggcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacgtcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgttcaggaaataaatgtgaattgccct

SEQ ID NO: 31627 - DNA, 295 bp, Homo sapiens
attcagatggattaaagacttaaacgttagacctaaaacctaaaaaccctagaagaaaacctaggcagtaccattgaggacataggcatgggcaaggacttcatgtctaaaacaccaaaagcaatggcaacaaaagccaaaattgacaaatgggatctaattaaactaaggagcttctgcacagcaaaagaaactaccatcagagtgaacaggcaacctacaaaatgagagaaaatttttgcaacctactcatctgacaaagggctaatatccagaatctacaatgaactcaaat

SEQ ID NO: 31628 - DNA, 209 bp, Homo sapiens
  misc_feature 2, 164: n = A,T,C or G
antctaatacaattcctaacagaaagttggtacaacactggctaattcagaaatcgctcctcagacttagattccaagagtatcaaagagattagatgggaggctgggccaggaacccttgttttaatgtatttgtccataattaacactggtgaccatataanggaacaaagtatatctgcacatttcactgagacatctacattggg

SEQ ID NO: 31629 - DNA, 462 bp, Homo sapiens
  misc_feature 16, 18, 25, 26, 30, 43: n = A,T,C or G
atttttgtacccgggnanctcggcnnttanggcccggggttcnagaggagtgttgtgaatgatttgggtgaagtgacttttctgttaaattcatacttactaaaatgtgtagtggtgtgaagtatgcattatagatgagggtgggtgggttctgacatttagtcagccttcagtttctttaatgcatttgctcagtctccagcatctgaaacccatagtttgcgtcctttgtcacataaatatttggccaaatatagatgtcagaaaagctgtgtgcacaccacataaatgtccagccttcctggctgagtgtggctgtgccatgcagtgctctggaggtgggttggtggttggaagtggaaacacagtttcaaggctttaaaaaagacagctgcttttgaagaccagctgtagttgtgggttcataccttcatgttgtcctagcattcaggatcctgtctg

SEQ ID NO: 31630 - DNA, 474 bp, Homo sapiens
  misc_feature 5, 54: n = A,T,C or G
gagancgccatcatgaacgacaccgtaactatccgcactagaaagttcatgacnaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatt

SEQ ID NO: 31631 - DNA, 194 bp, Homo sapiens
  misc_feature 41: n = A,T,C or G
ccttatggccgggagcttaaagtataaaaaagattcaagancagtgaggtttgttctttccagtgaatggtggactgagtggtgcgaggtggagggctaacaagagggaaagaactacattcttcagaatacagtgatgaaaattcattttgaaactcaaatattttcattttggatattctcctgtttttatt

SEQ ID NO: 31632 - DNA, 435 bp, Homo sapiens
  misc_feature 2, 7: n = A,T,C or G
cnagacngagccgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatat

SEQ ID NO: 31633 - DNA, 489 bp, Homo sapiens
  misc_feature 2, 4: n = A,T,C or G
cngntggcagtggctgtgctgaaggttggtgggcaagtgatgttgaagtgaatgaaaaagaatgacagagttacagaatgcccttaatgctacaagagcctgctgttgaagaaggcattgttttgggagggggttgtgccctccttcgatgcattccagccttggactcattgactccagctaatgaagatcaaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggt

SEQ ID NO: 31634 - DNA, 123 bp, Homo sapiens
  misc_feature 4: n = A,T,C or G
aganttgtgctgtctaatgactatttcatttaatccttccttgtctaaagcaatggtactggcattacaagatgttaatatggaacaccttgagaatctaaagaagcggttaaataaataatt

SEQ ID NO: 31635 - DNA, 179 bp, Homo sapiens
  misc_feature 12, 49: n = A,T,C or G
tatggccggganctaccttttctggttcttgtgttggctgtggcaggcnagctgtggttttcttttgccatgacaacttctaattgccatgtacagtatgttcaaagtcaaataactcctcattgtaaacaaactgtgtaactgcccaaagcagcacttataaatcagcctaacataag

SEQ ID NO: 31636 - DNA, 442 bp, Homo sapiens
gatgctggtaggtaatgttactaacagtgccattagtaacattaatgttactagggcctggactgatatgctgatggaagtgagaatgaagaataaggtgggatgaaagagattttgacaagagttttttaatgaacctgaaacgggaaagggcgagattaactaagcctgtttgccatggatagcaatggggttgctagaagattagctgtgcggaaaaattatgcatttacctttgggcataataaaatgcaattgactctccatattcatgggttctgcatccactgattcaaacaactgtggaacaaaattgtcagaaaaaacaatacagtgataaaaaatgatacaaataaaaaacaacatggtataccaactatttacatagcatttacatcgtattaattgttattaagtaatctagagatgatttaaagtatat

SEQ ID NO: 31637 - DNA, 134 bp, Homo sapiens
  misc_feature 2, 8: n = A,T,C or G
anggaaantagctgtgaagggaagataacaaacattttgtagacgtttggtgttgaatatatgctatggaggcagtttctatagtttcatttacttcatgaggtttcattttttcttttctgggcaacagagcg

SEQ ID NO: 31638 - DNA, 443 bp, Homo sapiens
gaaaaactgttttggccaactttctgacagtaatcttctgacatcactgaatacagcccaacccaaggagtgaggatcctagaatttgagaacccgcatgttaccagcaacaacaaaggcacgggctgtgaattcgagctatgggactgtggtggcgatgctaagtttgagtcctgctggccggtcctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcat

SEQ ID NO: 31639 - DNA, 174 bp, Homo sapiens
  misc_feature 3, 12, 39, 69: n = A,T,C or G
atngcccggganaattaaattcattttctctctgaaaantatttatatcttcatgcagcttttcaaccnagccatgcgccgaaataagcaaatcgaaagctgcaaaagctgcagcagtggaagtgttatgtgttaggcccgaaaggctgtgggtgtgaatttactagtatagcc

SEQ ID NO: 31640 - DNA, 349 bp, Homo sapiens
  misc_feature 19, 23, 27, 38, 56: n = A,T,C or G
gattacttggcccgggaantcgntttnttaggccgggnaaccaaatagtcctaatncagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctgccctgatca

SEQ ID NO: 31641 - DNA, 479 bp, Homo sapiens
gggtccaagattcactatggataaaatggggtgttaatttggttttcaaggccaatacaagaggaggcatagaaaaagaacaaggtggtgttgggaagtagtataaaaaggggcacaggcttatccttgttttataaaaaacaaaggtttttggaagggatttgtagagataagtttgaaaagtagtttgagactatgtgtggaaattcatgaatcttagagtttgattttattcaggagatcagtagcttttaaaatgtaaaataaaaccagtaaactctatctaaaataaattcttcccctaatcccaatataaaaaatacatataaaagcgtagctgctctagacaaaatggcgggtatgagatgaccagaaacctcaacggcactacctctggtagccccatagaactgccaagagttttcagagtatagttaattcctgctgacggctaaggcagtcattgagtgattggaaag

SEQ ID NO: 31642 - DNA, 143 bp, Homo sapiens
  misc_feature 1: n = A,T,C or G
nacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccac

SEQ ID NO: 31643 - DNA, 481 bp, Homo sapiens
cgaggtggatgccacactcaagtccctcaacaaccagattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatc

SEQ ID NO: 31644 - DNA, 127 bp, Homo sapiens
  misc_feature 9: n = A,T,C or G
gtatcaagnaactcagcatttctttgcatccatggacttggtttggagacataaggaatattctgaccctttttaaaaaaggattttctcatgtttttatttaacataaataaaagaataacatttt

SEQ ID NO: 31645 - DNA, 253 bp, Homo sapiens
  misc_feature 1, 2: n = A,T,C or G
nnggctgaacgcgtgtgtacacgggactggcgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatggtt

SEQ ID NO: 31646 - DNA, 376 bp, Homo sapiens
  misc_feature 363: n = A,T,C or G
tcaccatgatctaattttagaacattttcatcacccacaaacgaaaccttacacccatgagtcactttccatttacttctccccttgtcaaaaatcaattgaccatagatgtatggatttctggactctcagttctgttcccttcctgtctgtatctgtccttatgccagaaccacactgtcttggttactatagttttgtatatagtagtccgccttctcagtgattttgccttctttggtttcagttacccctggtcaactgaggttcaaaaaccttaagatactttgagggagagagcgaccacattcacataccttattacaatatattgttataatttttctattttattattattgntaatcttttactg

SEQ ID NO: 31647 - DNA, 364 bp, Homo sapiens
gtattttctcttttaagattttacaatatggattgtgtagagctttgctactcttagtgtggttgacagaccaacagcatcagcatcacctgaatcagaatctgcattttaacaagatccccaagtgatacatgtgcatattaaagtttgagaggcattgatgtggtgattaagaatacaggctttagagtgagtcagtctgggttcagattccagttccttgccttgaccttggctaggtttcttaaactttttaaatccatcacatcttcgtctgttaataggtataataatggtccttaccatgtagaaatattttaaataagataatgcatgcaaaacacttaactttatttttatttat

SEQ ID NO: 31648 - DNA, 427 bp, Homo sapiens
  misc_feature 1, 2: n = A,T,C or G
nncttaaaatatttctcaactttctaaaacatcaagaaaagctctctatacaaataccatggttgattttaattattttgttttccatccttttaaaaatattttctgctttgcatcccattattattttgagtttcttttcatttgtagtttgttgttcattgtgttgttttacagctaagattcatttcatacgtttgatgcttagctgaaaaattacaataaattctccaatgaaattatgtatctttatttaatgaaaatgcctgctgcgtaccaaggtatgtactagggcatctggggtaagtaaaaacaaacacatagagcctgcctggagaagctcatggtctgatggaaagataagcaaggagagttaatttctaatcaatatgataaaaaggtcagagagcagtttctgaaaaacatg

SEQ ID NO: 31649 - DNA, 474 bp, Homo sapiens
  misc_feature 14, 18: n = A,T,C or G
ggatactcctcganagancaactccaagacacataattgtcagattcaccaaagttgaaatgaaggaaaaaatgttaagggcagccagagagaaaggtcgggttacccacaaagggaagcccatcagactaacagtggatctctcggcagaaactctacaagcaagaagagagtgggggccaatattcaacattcttaaagaaaggaattttcaacccagaatttcatatccagccaaactaagcttcataagcgaaggagaaataaaatcatttacagacaagcaaatgctgagagattttgtcactaccaggcctgccctacaagagctcctgaaggaagcactaaacatggaaaggaacaaccggtaccagccactgcaaaaacatgccaaattgtaaagaccatcactgctaggaagaaactgcatcaactaacgagcagaataaccagctaacatcataatgacaggat

SEQ ID NO: 31650 - DNA, 442 bp, Homo sapiens
  misc_feature 10, 11, 13, 20: n = A,T,C or G
catttcagannanttcaganatctgagcccacagaaattctgcaaaacaaggtgtgaacagtgacaagtcaagattaagattaagataggattctaaactctagaaacagatgggttccaagggcagagcagagagctatccagtgaataatctagagtaggaagtgatcagggctgacggaagttgtagctatattggaatttgccatttttagaagggggatcttgaacactggcttagtcccactcttccttttaaagtccctggctaaaggaattgtattgggccaaaacctctttttccttttcatgaaagaagatatattcatctcccatgacctcaaattttgaaatgaatgccatgtagtttaattaacctttctctacaatttgccacctcaaatgtttattgttcaattctctattttaagctagacagaat

SEQ ID NO: 31651 - DNA, 483 bp, Homo sapiens
  misc_feature 24: n = A,T,C or G
ggctgcctctagttctgggaaganggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggaga

SEQ ID NO: 31652 - DNA, 295 bp, Homo sapiens
ggaattagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatgac

SEQ ID NO: 31653 - DNA, 321 bp, Homo sapiens
  misc_feature 177, 178: n = A,T,C or G
tagcttgaactaactcactgttaggaggacagcaccacagataaaccattcatgagggatccacccccatgatccagttcctcccaccaggacccacctccaacactggagattacatttcaacatgagatatgggtggggacaagtatccaaactatatcaacggtaatctgcctnntaaaacgtatatcaatattcaaagcattttgaaataagaataaaacaaggctcagcagtggctcacgcctgtaatcgcagcaccaaggtgggagaatcacttgagcccaggagttcaagaccagcctgggcaacatagtgaga

SEQ ID NO: 31654 - DNA, 390 bp, Homo sapiens
  misc_feature 3, 7: n = A,T,C or G
aanctgntaagatgacttgagatgagatgaaatgatgagatgaaatgacgaaatgagatgagatgagatgatgagatgaaattttgagatgaaatggtgagtagaaatgagatgaaatgatgagacgaaatgacaaaattgaaaagaaattgaaaggagatgagatgagataaaatgagatgaaatgatgagatgatggatgaaatgatgagatgaaatgatgagatgaaatgaaatgaaataatgaaatgatatgaaataatgaaattgaaatgagatgagatgagatgaaatgagataaaatgatgagatgaaacgagatgaacgatgagatgaaatgatgagatgaaatgagatgaaaaatgatgagatgaaaaatgagatgaaatg

SEQ ID NO: 31655 - DNA, 445 bp, Homo sapiens
  misc_feature 4: n = A,T,C or G
gganctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaaagtggtcagcgcat

SEQ ID NO: 31656 - DNA, 479 bp, Homo sapiens
  misc_feature 11: n = A,T,C or G
gatcttcatgnattctacattgtttccgtgtcccacggtaggcagaattttacttaggttccccagcctcttgtaaaagttccccgggtctattttcccagctgtgaaaaatcaattccagtttgattttagtgcaccaagcctcctttcatccaccactagagaactccaatgatcatcattttattctgtactgttttctcttctgtagcctgccacccttcatctttcatccagctggaatctagttactctgcttttaacaggcaaactcttattcttaatgtatctgtagtttatcatagatacagtagccacatgtcccaatcttccaaggcaagtttcagtttatgcctgtctttcagtgtaattattaatagagacttctttcactctgaagatcctggtttgacaattttatgttcacctagccacagaacacatagaagatatttcttgttgctgctgtagctatagtc

SEQ ID NO: 31657 - DNA, 206 bp, Homo sapiens
agcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttgggtttatgcaaatacaatcagcccagtcca

SEQ ID NO: 31658 - DNA, 243 bp, Homo sapiens
  misc_feature 1: n = A,T,C or G
nggccggggcctttggattaaaataatgctacaagaactgctttttaatctatatattccatcattcaaattcaagtgtcttaagccttttacataccaaaataggtatatttgaatacaggagaagtcaaagaaaggcaatctggaccagaattctgatttttctgggtagtaaagtttccttcagaatgctggtggccagcataggattgccagtcctttattttgccaagtaagaacatc

SEQ ID NO: 31659 - DNA, 487 bp, Homo sapiens
  misc_feature 15, 31: n = A,T,C or G
ggagcatttaagaancatcctctgccaaganccaaaggaaagaagaaaaagggccaaaagccaaaatgaaactgatggtacttgtttccaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcgatgagaatcttcatgtattctggagaacaccattcctgatttcccacaaactgcactacatcagtataactgcatttctagtttctatatagtgcaatagacattagattctataaattcttacttgtc

SEQ ID NO: 31660 - DNA, 224 bp, Homo sapiens
  misc_feature 3: n = A,T,C or G
gangcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatga

SEQ ID NO: 31661 - DNA, 464 bp, Homo sapiens
ggctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactg

SEQ ID NO: 31662 - DNA, 220 bp, Homo sapiens
  misc_feature 9, 10: n = A,T,C or G
aggtaaagnngaagtcaaactgtcgctgtttgctgatgataagattgtatacctagaaaaccctaaagactcctcctaaaagctctcagaactgataaatgaattcagcaaagtttcaggatacaaaattaatgtacacaaatcagtagctctgctgtacaccaacagtgaccaagatgagaatcaaatcaagaacccaacaccttttataatagctgcg

SEQ ID NO: 31663 - DNA, 425 bp, Homo sapiens
cgggtgtgagccttttcgcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaattt

SEQ ID NO: 31664 - DNA, 464 bp, Homo sapiens
  misc_feature 7, 8: n = A,T,C or G
gaaaaannttagacgaatggctaactagaataaacagtgtagagaagaccttaaatgacctgatggagctgaaaaccatgacacaagaacttcgtgacacatgcacaagcttcaatagccaatttgatcaagtggaagaaagggtatcagtgattgaagatcaaagtaaggaaataaagtgagaagacaaggttagagaaaaaagagtaaaaagaaatgaacaaagcctccaagaaatatgggactatgggaaaagaccaaatctatgtttgattggtgtacctgaaagtgatggggagaatggaaccaagttggaaaacactcttcaggatattatccaggagaacttccccaacttagcaaggcaggccaacattcaaattcaggaaatacagagaacatcacaaagatactccttgagaagagcaaccccaagacacataattttcagattcaccaaagtc

SEQ ID NO: 31665 - DNA, 438 bp, Homo sapiens
  misc_feature 4, 5: n = A,T,C or G
gggnnatgtaagccttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtctttcttcacagaataatgtgccagttttttg

SEQ ID NO: 31666 - DNA, 489 bp, Homo sapiens
  misc_feature 1, 2: n = A,T,C or G
nnagtggctgtgcaccatcattctctcatagaacttggttgagttttaatgcacagctgtgatccaccccagtcctacaaattagagttgctctgacttgtacaatgatggaaataaatctgtctgcaagcagggcactatttactcttcagattctttaatcacatctggctcctgcaagttcaattccacttgtcaatttctagatatgtagggaaatagggaagatgtagataatctgataatgacagcattgaactgtgttatattatcagttacttttcctagccttttgttgacatctggtagactccacacatatagcacttttcaaatgttgcaacatgtcaaattcctaacatcaaaatttatatatccaggtaacatttatcccttccaatcagttttactgaattaggtatacttggggtttgctcttatctgtctctacttattagacccaagtaacatttacctcttccaatcagt

SEQ ID NO: 31667 - DNA, 465 bp, Homo sapiens
ggcaatcctaagcaaaataataaagctggaggcattatgttacccaacatcaactatactatgcggctacagtaacccaaacagcatggtactgggtacagacacatagaccagtggaacagaataaagagttcagcattaaggccacacatctacaaccatctgatcttcaacaaagctgataaaaacaagcaatcaggaaaagactccctattcaataagcggtgctgggataactggctagccatatgcagaagatttaaactggactctaccatatatcacatacaaaaattaactcaagatggattaaacacttaaaatgtataacccgaaactagaaaaactctggaagataacctagtacataccattctggacatatgacctggcaaagatttcatgacaaagatgccaaaagcaattgaaacaaaaaacattgacaaatgggatgtaattaaacta

SEQ ID NO: 31668 - DNA, 121 bp, Homo sapiens
  misc_feature 3: n = A,T,C or G
ggnatgacaatcgctcgaacctgggaggtggatgttgcatgagaatcgcttgaacctgggaggtggagctgagatttcaccactgcactctagcctgggcgacagaatgagaccctaccat

SEQ ID NO: 31669 - DNA, 214 bp, Homo sapiens
  misc_feature 1, 2: n = A,T,C or G
nnttgagaagaagccttctgtacttgaagttgatttgaaatatgtaagaattgatgatgtatttgcaaatattaatgtgaaataaattgaatttaatgttgaatactttcaggcattcacttaataaagacactgttaagcactgttatgctcagtcatacacgcgaaaggtacaatgtcttttagctaattctaattaaaaattacagactgg

SEQ ID NO: 31670 - DNA, 379 bp, Homo sapiens
  misc_feature 2: n = A,T,C or G
gnacataatgaatgaaatgatgaaatggaataatgaaatggaaatgatgagctgagatgcaatgagttgaaatgagatgaaatgatgaaatgatgagatgaaatgatgagatgagatgtgatgaaatgatgacatgaaatgatgacataaaatgagatgaaatgagatgtaatgatggaatgagatgagatgaaatgagatgaaatgatagatgagataaaatgatgatatgaaatgatgagatgaatgatgagatgatgagatgaatgatgaaatgacatgatgagatgagatgatgaaatgaaatggtgagatgaaatgatgagatgaaatgaaatagtgaaatgaaattgaaataaaatcgaaatgagatgaaatg

SEQ ID NO: 31671 - DNA, 477 bp, Homo sapiens
  misc_feature 4, 21, 22, 48: n = A,T,C or G
ggtnctgacagtattcacagnntatattggaggattcttgtccatagngcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgc

SEQ ID NO: 31672 - DNA, 315 bp, Homo sapiens
  misc_feature 2: n = A,T,C or G
gnaggtaggaaaacctaaacttaattgacgaattgttggatgttcgatgtggacacatctgagagttaaaaactccaggaagacccagacagagaagggtccccacacttctgtgagtttgacacctagcttgactgggttctcacagtgaatgttggagaaaaatcttctcatgcttccagaaagggaaggtgaaaaggaaccgtcttgaagtacaccagagctttctgttcttcttaacaaggtctttcctcaagggcaaatatttcacctaagctactggtgttttgttttcttttgttttgttttgttttg

SEQ ID NO: 31673 - DNA, 462 bp, Homo sapiens
ctagcaagggagatagtaaatatataaataaaactaaatattaattacgattgtgatgcatgctgtggaggacagtagagggtgctgtgaggatacataatggagtcaccggcatgcggagggggaaatgaggagagacagggaaggctttcccaagaaaataatatttagctgagacttaaaggactgagttggagttaaattggacaaagagctaacaggaggagggaagggcatgtgtgaggtcttgagactaggaggagcttgtatcttgttacttaaagacccctgtgaggctgtaggtggtggctcacacctataatccgagcgctttgggaggctgaggtgggaggatcatgtgaggccaggagtttgagactagcctgggcaacatagggagaccccatttctacaaaaaataaaaaattatctaggcgtgctggtgtgtacctgttgtcccag

SEQ ID NO: 31674 - DNA, 131 bp, Homo sapiens
acatcttttgtgaaatacttttattttgttatgctttaaatatacatacaaaaagatttctgttattagctttgaaaattgtataatatcctaatataaacaaaaatataaaaataaaaatgaatacagtg

SEQ ID NO: 31675 - DNA, 325 bp, Homo sapiens
agcttaaaattggccctaaccaattctttttaaatatgctcatagtcctataaaatttttgtgctttagaaagatgaatattcttagtatctagattttcctggagacttgttttcctagactggatcttttaacatggtagttaactagggtataataggagtatgtcttatttttaaatttttctggcattctttagttcaacaaacgttttagtacctcctatgtgctgagttctttggatacaagggtggttaaacacagacttgtattattattattattattgttaatttatttttgtgacagaccaagaccctgtcgc

SEQ ID NO: 31676 - DNA, 142 bp, Homo sapiens
  misc_feature 2: n = A,T,C or G
anggcacatgcagcgcaagtaggtctacaagacgctacttcccctatcatagaagagcttatcacctttcatgatcacgcccctcataatcattttccttatctgcttcctagtcctgtatgccccttttcctaacactcac

SEQ ID NO: 31677 - DNA, 204 bp, Homo sapiens
  misc_feature 6, 11: n = A,T,C or G
aacagnaaganacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactac

SEQ ID NO: 31678 - DNA, 438 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaacttttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtg

SEQ ID NO: 31679 - DNA, 370 bp, Homo sapiens
  misc_feature 1, 6: n = A,T,C or G
naaggnatgagagtaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatat

SEQ ID NO: 31680 - DNA, 400 bp, Homo sapiens
  misc_feature 19: n = A,T,C or G
cagtatttaaactgttccncaattttgtgaggctgtgttggaaataaccccgcctctagtgctgttggtatgcaaggcagcggtgcttaatcaatatttcccgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttccgcatcaactgctatgacggttaagaatgtcagtatacaagaaggaatagaaaactgatactgtttt

SEQ ID NO: 31681 - DNA, 253 bp, Homo sapiens
  misc_feature 4, 6: n = A,T,C or G
gaantntaaaaggtataataataagaaactaatagtaatgggatgtcctgttttcctttaaaattttcatactcttgggtaccttacacatttggttgactccttgattttctttttaactattcaccttaagcacattcattttagtttcattaaagggatgttgattccttgtttattctatttttagcattcttattaaagtttagaaaaacttgttgagttttgttgttcatatgtataggaaaaaaat

SEQ ID NO: 31682 - DNA, 378 bp, Homo sapiens
aagaaggtgatattgtagacatcaagggaatgggtactgttcaaaaaggaatgccccacaagtgttaccatggcaaaactggaagagtctacaatgttacccagcatgctgttggcatcgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcat

SEQ ID NO: 31683 - DNA, 283 bp, Homo sapiens
  misc_feature 23: n = A,T,C or G
cagaggctgtagatctacacagnaatctttttactgctttattattatataggcagtgctaccttttctcaaataccagtatattcaataataaaaattgattcattgagtacgtttaaccacattttatgacctttaaaagatgtcttcatagtatgaataggatatgttccaaaagttagtctataaataaattgctggaacatatcctcagcagcttaaatgacaggttttatggtatgttctgggaaactatttatctaactaggtgtgattaaagtgc

SEQ ID NO: 31684 - DNA, 242 bp, Homo sapiens
cttaagtgttgctgtttctccctccatgttccatcttcactactgttatcccactctgtagatttttccctaagctggatcattcacagaaagtgcttgtctcttagatctatttctccagcccagatgcctcccctaagctctagaccaggggtatccagtcttttggctttcctgggccacactgggagaagaattgtcatgggccacacataaaatacactaacaatagctgatgagcc

SEQ ID NO: 31685 - DNA, 336 bp, Homo sapiens
  misc_feature 10, 20, 41, 44, 48, 50, 54, 61, 70, 71, 73, 74, 79, 81, 95: n = A,T,C or G
ccctgggaanctccggccanttaatgggcccgggattaacnagncgcnantccnatgtctnagaggtccnnanncaacnantagggtttacgaancctcgatgttggatcaggacatccccaatggtgcagcccgctattaaaggttcgttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagg

SEQ ID NO: 31686 - DNA, 188 bp, Homo sapiens
  misc_feature 7, 21, 28, 29, 33, 45, 46, 85, 88, 95, 159: n = A,T,C or G
gattttngtaccccagggaanctcggcnnttantggcccgggganntaagtattgataaaaaaaaaagaaccttgaaaatgttgngtncccctgnggatttgaggcttattactaccacctggctggataaaatgtcaaaaccttcaatcacttaaggngactggaacttttgtaaaatacacttatg

SEQ ID NO: 31687 - DNA, 393 bp, Homo sapiens
attctagaaggcagtacaaaaggaagggttggaagcaaaataaaaaaactttactgtgaaggtggtatttaaaaatgcattttcctatgcaaactatagtcctgttacacaaaagttaaagggtattatgtgggtgtgtaaatacaatagtccccactgtccactgtttcagttacctatggtcaaaaagaaaaaggggaagtacagtataataaaatattttcagagggagagaccacattcatataacttttattacagtatattgttataattgttctattttataattattgttaatctcttactgtgcggtcccagctccttgggaggctgagacaagagaatcgcttgaacccgggaggcagaggttgcagtgagctgagatcacgc

SEQ ID NO: 31688 - DNA, 318 bp, Homo sapiens
  misc_feature 16, 311: n = A,T,C or G
aagtaaaagctgagantgagtttcttactgaacaactttctgaaacacaaattaaattcaatgccttaaaagataagttccgtaagacaagagatagtctcagaaaaaagtcattggctttagaaactgtacaaaacgacctaagccaaacacagcagcaaacacaggaaatgaaagagatgtatcaaaatgcagaagctaaagtgaataattccactggaaagtggaactgtgtagaagagaggatatgtcacctccaacgtgaaaatgcgtggcttgtacagcaactagatgacgttcatcagaaagangatcatt

SEQ ID NO: 31689 - DNA, 484 bp, Homo sapiens
  misc_feature 7, 16, 40, 41: n = A,T,C or G
ccgggantctcggccnttatggcccggggagccggcaganncagcatccagcggcggcgccagcagttccagtccgttgctttactttttgcttcaccgacatagtcattatgcccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaaagaaggaggaaaagcaggaagctggaaaggaaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcat

SEQ ID NO: 31690 - DNA, 316 bp, Homo sapiens
  misc_feature 257, 264, 279, 303, 306: n = A,T,C or G
ccggcggtgacgacctacgcacaggaagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaangatgttncttcaggaggaaacngcccttaaaaccctttgagtcaanaanagggggaaac

SEQ ID NO: 31691 - DNA, 494 bp, Homo sapiens
  misc_feature 8, 14, 22, 23, 25, 41, 42: n = A,T,C or G
gtaccccngggaanctcggccnntntatggcccggggggannatcaaatataagaaccgtccgctggagcctttgtggaatctttagagccctctcatgttgttcaagttcgctgttcaagtatgatgaaccagggcaacgtgtaccggccagatcacccgtacgccatgcacaccccggcagactctggccatctatgaccggtttggccggttgatgtatggacagggaagatgtacccaaggatgtcctggagtatgttgtatccgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgcttgga

SEQ ID NO: 31692 - DNA, 345 bp, Homo sapiens
  misc_feature 9, 14: n = A,T,C or G
cgtgtcccntggcnttttaggtgtcggttgggtaggcagtcatggatcaggtaatgcagtttgttgagcccaagtcggcagtttgtaaaggactccattcggctggttaaaagatgcactaaaccctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttg

SEQ ID NO: 31693 - DNA, 460 bp, Homo sapiens
  misc_feature 12, 15, 23, 24, 28, 30, 42, 43, 44, 49, 52, 57, 59, 66, 69,79, 91, 102: n = A,T,C or G
gtacccccgggnacnctcggccnnttantnggcccgggggcnnnagtantcnaaccngngtgtccnccnagtggtgganctgggtaaaganatgtggtaccntataccacccatggaatacctatgcaacccattaaaaaagaaataaaatcatgtcctttgcagcaaccatgggtgcagctggaggtcattatgctaagtgaactaacacagaaacagaaaatcggatatggcatgtttttacttacaagtgggagcttaacactgagtacatatgaacatgtggaacatggatgctggggaatataagaagtgggcacgagggaggggatgaagggttgaaaaactacctattgggtactatgctcacttcctgggtgatggggtttgattgtactgcaaaacttagcatcatgcaatatacctctgaaacaatcctgcacatgtacctctgcaatcc

SEQ ID NO: 31694 - DNA, 488 bp, Homo sapiens
  misc_feature 7: n = A,T,C or G
ggaaaantggggccaggtagtcagttatttaataaaagtttttaatattcttgaattctggggaggaaagcaaaaagctaattaactttagttttcactaagaatatgtattaaacattgaaaaaaaatctggaaaaataaaattgacaatatttgagttctccagagaaacagaacaaattggaagtgtatatatacacagatatattatatattttaaagaattgactcatgagattgtggggtctggctgcagggaataggtgaatattgccgtcttgaatccaaaggcagtttggaggcagaatttcttcttcttcaggggacctcagtaattcttcttaaggcctctgactgttggatgaggttccccaacatcatggagggtgacctgctttactcaaagtctactgactgaaacgttaatcacatctaaaaaatacattcacagcaacatctagactgctgttttaccaaaaaccaagtac

SEQ ID NO: 31695 - DNA, 349 bp, Homo sapiens
  misc_feature 14: n = A,T,C or G
agctttgcaagacntgttttccaacggagagagaattacatggctccccaaaggcagcaagtgtcacgtggggaggaaactaccagttctttgaagatctcatgactgtgttcagcccaaatcctgccatttttttctggaataatcttaaagcagtgaacctgaggcccaggcctttcatagagtgatctataacagaaatcttcatggcataggaccctaataaaaggcctacattgatagaaggcaaattatttttaatatcccgtatgcattttctgaagggcagaagtgtattacaggtggtttatattctaaaaggaacacaaaaaagggaactgtggtggga

SEQ ID NO: 31696 - DNA, 201 bp, Homo sapiens
  misc_feature 2, 21, 22, 33: n = A,T,C or G
cnagggcctgcatctgcaaannggccgtcgganagtgcagcctgctgcgcctgatgctgggacagccccgctcccagatgtaaagaaccgcgacttccacaaaccctggattttttatgtacaacccctgacccctgacccgtttgctatattccctttttctatgaaataatgtgaatgataataaaacagctttgactg

SEQ ID NO: 31697 - DNA, 222 bp, Homo sapiens
  misc_feature 6, 17: n = A,T,C or G
gaagangaagaagaccnaggcccaccatgccccaggctcagcagggagctggtggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaag

SEQ ID NO: 31698 - DNA, 235 bp, Homo sapiens
catttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgacttttcc

SEQ ID NO: 31699 - DNA, 374 bp, Homo sapiens
  misc_feature 6, 20, 44: n = A,T,C or G
cggccnttatggcccggganctgttataggttgttggataaatnagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacattt

SEQ ID NO: 31700 - DNA, 355 bp, Homo sapiens
ggcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggagga

SEQ ID NO: 31701 - DNA, 137 bp, Homo sapiens
  misc_feature 7, 21, 35: n = A,T,C or G
tcggccnttatggcccggganctgatgaaatagcnaaagttaatgactaaatactgtcttggttttttcgttccaggtcagtcaatattaacttcttataattttcttttttttctttatgtgtgtgtgtgtgtgta

SEQ ID NO: 31702 - DNA, 257 bp, Homo sapiens
ctacaatgggacttttaaaaatactcacagtcactagtgcacaagaagaaccattcaaagccggcatccaacctcagatttgcagcaacctaagatttgtttgcaaaggaatagaacgataaagcttcaacccacccacgtttataactgagaagaaaacacacacttcacttggtaaatacagcaaacaactgaaagtatgctttgactctgtattgaggccagttaggggatggaaagggtgaggctaagcaggt

SEQ ID NO: 31703 - DNA, 196 bp, Homo sapiens
  misc_feature 33, 50, 68, 93, 135, 148, 165, 172, 186: n = A,T,C or G
gaattatatctcaacaaaactgttaaaaaaccnaaaaaaaaaagaagtcngctgaaagtttttgaggngctcctttgtgaagagggaaggagncattatttttcctttttttatgatagactgggataggccatnctgaataatgtancagagtaaaatagaatnttattgngataaactgttgcncagcaagaat

SEQ ID NO: 31704 - DNA, 375 bp, Homo sapiens
gggctgctgcggggccctgcaagagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtgggagaaga

SEQ ID NO: 31705 - DNA, 260 bp, Homo sapiens
  misc_feature 2: n = A,T,C or G
antgtaattggtttcttttgatcctttattctcttcttgtattagactcttgtagtctgtaacacagttatcctaaaagatatcattagagcagaaaatagacttctagataaagtattttccttgcagattgaaaagtaggcgatgttttcagaagtaagattaggctattacaattccaaatgtgtatgtaatttgactgatgaatatcttcctaaatgttagaagactttactaaattgatttatctactctgggtt

SEQ ID NO: 31706 - DNA, 220 bp, Homo sapiens
  misc_feature 3, 14, 22, 42, 43, 49: n = A,T,C or G
gtncccccgggaanctcggccntttatggcccgggaagaaanngcagantctgaagcccccactctggacccaggacattttgatgagatccaaaggagttgtatgcaccatgaaagtttgagaagcatcatcatagagaagtaaacatcacacccaacttccttatctttccagtggctaaaccacttaacctctctgggtgttacctgctcatttgtc

SEQ ID NO: 31707 - DNA, 111 bp, Homo sapiens
gacgttggccttggtaagattttttggatatcacaccaaaagctcatgaagcaaaaacaaaaataaacaatttggactatatcactctaaaaagcttctgcatggcaaagg

SEQ ID NO: 31708 - DNA, 290 bp, Homo sapiens
aggccgactaagaaatccctaagcctagctgggaaggtgaccgcgtccacctttaaacacggggcttgcaacttagctcacacccgaccaatcagagagctcactaaaatgctaattaagcaaaaacaggaggtaaagaaatagccagtcatctatcgcctgagagcacagcaagagggacaatgatcgggatataaacccaggcattcgagccagcaacggctaccctctttgggtcccctccctttgtatgggagccctgttttcactctattaaatcttgcaactgc

SEQ ID NO: 31709 - DNA, 372 bp, Homo sapiens
  misc_feature 3, 11, 29, 34: n = A,T,C or G
acnttcggccnttatggcccgggcctgancggangttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattattggggagtggtagggatgaaacaatttggaga

SEQ ID NO: 31710 - DNA, 114 bp, Homo sapiens
  misc_feature 6, 20, 21, 25: n = A,T,C or G
ggtgancggtcctgacaganntganctattgggggccttggtggtgctgccctcttctggtcccgagatgtggcccgtagttaaagtgacccatgaattttgagccaaataaag

SEQ ID NO: 31711 - DNA, 367 bp, Homo sapiens
  misc_feature 342: n = A,T,C or G
atagaaagtagaacaaatagtgtcatgatctcccatatacctgtcagattcaacagttaccaacatatgaaaaatctaagcaaccccttccctccccctggttggattattttaaagaaaatccagctgggagcggcggctcacgcctataatcccagcactttgggaggccagggcaggtggataacttgaggtcaggagttcgagacaagactggccaacatggtgaaactctgtctctattaaaaatacaaaagttagctgggcgtggtgccgagcgcctgtaattccagctactcaggaggctgaggcaggagaatcgcttgaacccaggagtggaangtttgtaagtgagccgagatcgtgc

SEQ ID NO: 31712 - DNA, 150 bp, Homo sapiens
gttttaagaaacaaagtaactctatacacttcaagactttacaggattttttaaatcctgtattgttggatcaattaataaagatgcaaaaaaactttatagagatgtaaaaacaaaactataatggatctcctatttttctttaaatac

SEQ ID NO: 31713 - DNA, 199 bp, Homo sapiens
  misc_feature 5, 7: n = A,T,C or G
taaananctggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaga

SEQ ID NO: 31714 - DNA, 413 bp, Homo sapiens
  misc_feature 4, 10: n = A,T,C or G
ggancttccntgtgaataccccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggcttggaaggaccaaggtgtcctaccgctggttcctacagcacaggccccaggtgggctacatcagggtacgattttattgaaggctctgagtttggtggcttgactctggcgtcaccatagacaccacaatgcgtgga

SEQ ID NO: 31715 - DNA, 131 bp, Homo sapiens
  misc_feature 11: n = A,T,C or G
aattccggccnttatggcccggggccttttatgaaatacatacacaccttatggctgccgtgtacaagatatacctgatgacagatagtaaacctactgctttaaacaaatgccaagcctattcagaccct

SEQ ID NO: 31716 - DNA, 344 bp, Homo sapiens
ctttccggcggtgacgacctacgcacacgagaacatgccctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 31717 - DNA, 360 bp, Homo sapiens
acaggcttgaaggcaaaggtaacataaccttctcaagacagtaagtatagagtgatggtgcacactggaagagatggtagaattaggcaggatattgtaagccttgaaaaagaattaggcaggatatcggaagccctgattagattctatcctaagagcaacagaagatcactgacagtgttttaaatagatagactagtttattagatttgcagtttagaagttccctttttttgtaattattggacagtgtagagaccggatggtgagagatgagttaggaagttgtgacagctctctatacctaccgctaatgtagaggattatttattttcatttcattaccattcgtgtaaggtg

SEQ ID NO: 31718 - DNA, 161 bp, Homo sapiens
  misc_feature 2: n = A,T,C or G
ancgagtgtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcctagtg

SEQ ID NO: 31719 - DNA, 294 bp, Homo sapiens
  misc_feature 233, 288: n = A,T,C or G
gaaacagaaaaaaaaaatctgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgnggttggatctaacactaactgtattgttttgttacatcaaataaacatcttctgnggacca

SEQ ID NO: 31720 - DNA, 439 bp, Homo sapiens
tagcctgggcaacaagaggaaactccgtctccaaagaagaaaaatgaatagaattcagcaatatatgaaaagaattatatactatgaccaggtggggattattccagggatgcaaggctaagtcaatattcaaaaatcagtcaatgaaaaaaaatcaatcaatgtattccaccctgttaacaggctaaagaaaaatcaattgacagagagaaagcacttgacaaaattccgtacccattcataataaaaactctcaggaaactagaaataaaagggaattttctcaatttgatagagtatctacaaaaaacctacaactagcatcatacttcacagtgagagactgaatgctttccccctgactgaacacaaggcaagcatgtccactctcaccaatcttattcaacacagtgctggaaattgtagtctgtgtaataag

SEQ ID NO: 31721 - DNA, 442 bp, Homo sapiens
  misc_feature 235, 272, 345: n = A,T,C or G
gaaagcacattcgccttctttcttaaagattcttaactatcactgtgaaaagcgttccattaccactgacaatactttttttaaaagacgttaaacacaatattttgagataaggcgcgcacacatacacatacacacacacacacacacacacacatatatatatataaagagagatgcctcttttgtttaaagttattttgaaaatcaagagcattgtttcatttgttttctntggtgtgtttttacagaaaagcttaggcatagcagtnacacttaggtacttttgctgtattctccttccagtgtaaaaaggacagcagtcactttcaaatcaattcttangagtccttgattcttgaaggctgctattcacacataacaaccagaatctaatataggcaaactttgcatcttcagtaaggaaatagacatttaatac

SEQ ID NO: 31722 - DNA, 271 bp, Homo sapiens
  misc_feature 13: n = A,T,C or G
tatggcccggganggaagaaggttgtgctaagttactaatccaggcaatgagtttggcatgtcaaagaacagaaaaaaggggccactaaggctggagcttagagaggaaaggagacaatgttatgagacgggtttggagagactggctgggacctacgtcataaaaggtttttgtaaggtgatctgaagcatttggattttatattagtgcgatagaagctttcagagcatttgagatagggaagtattgttacctgataaatatttgaga

SEQ ID NO: 31723 - DNA, 366 bp, Homo sapiens
  misc_feature 4: n = A,T,C or G
gacnctggatccgcatgcgcctcccaggaggggcggccctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatat

SEQ ID NO: 31724 - DNA, 289 bp, Homo sapiens
gttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcattcaagtagagaaaataatatgtgggttaaga

SEQ ID NO: 31725 - DNA, 146 bp, Homo sapiens
tcggcccttatggcccgggcctgataataaaaattgtttgaccatgtattttgttatgaatagtttatcttccaaaagatattttgctctattttaaagtgtagaagaatacactgctaataaataataaaagttttattcaattt

SEQ ID NO: 31726 - DNA, 368 bp, Homo sapiens
  misc_feature 2, 19, 29, 347: n = A,T,C or G
gnttttttgtccccagggnaattcggccnttatggcccggggagcctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttncgtggttgcatttgtggatgc

SEQ ID NO: 31727 - DNA, 336 bp, Homo sapiens
  misc_feature 1, 13: n = A,T,C or G
natttcatgaatnttctatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttat

SEQ ID NO: 31728 - DNA, 438 bp, Homo sapiens
gaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatattggatgtaaaagaagtaactttgtgtctcatgaaaatcagtacaatcacacaaggaggatgaaacgccggaacaaaaatgaggtgtgtagaacagggtcccacaggtttggggacattgagatcacttgtcttg

SEQ ID NO: 31729 - DNA, 381 bp, Homo sapiens
  misc_feature 4: n = A,T,C or G
agantggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatgggagaattcaaaaacaaggcttttgctcttgaagttattaaatccactcatcaatgttggaaagcattgcttatggaagaagtgtaatggaggagctataaattgcacaaacgtgcagatatctgatagccctttccgttgcactcaagaggaagcaagatcattagttgaatcggtatcatcttcaccaaataaagaaagtaatgaaagaaga

SEQ ID NO: 31730 - DNA, 176 bp, Homo sapiens
cacttggctcagatgactatcctgttgtccctctaaccaattattaggttcccaggtttcccctagagtagaatgccagataccttccctttccattgttaccccatggcataaatcttcagtaatacccggcttcggagttggctctttggtttcaagtcttgtctcccagtcgc

SEQ ID NO: 31731 - DNA, 333 bp, Homo sapiens
gggaaagacgctgaaagagcccctctgagcccctgtgcactggtgtagccctccgagttgtctgctggagacaggtagagaggctgtggtgaccccttccccttgccctcacacggtctgttcctccgctctccaaaatcaagggagtctggggctggtaagagcagcctgttgtgctttgtttcaaggaaagaagtctcaaggaaatgcagctaaaatttatttcaaagaatgagaaaactccctattgcccctggagtaaagtgggtacaccacaagtgtgtcattcactagtctatatgggggtgacacgggacccctgtaggattttat

SEQ ID NO: 31732 - DNA, 458 bp, Homo sapiens
  misc_feature 11: n = A,T,C or G
ggcgcaatagnatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgttcaagctcaacacccact

SEQ ID NO: 31733 - DNA, 372 bp, Homo sapiens
  misc_feature 12, 371: n = A,T,C or G
caagggacaggnactctggctgagcctggtggcactgcccagttttatatagacccagtttgctccatgacataaaattgacctatactttttccaggacagggtgtatctgttggttctggggtttcaagctgctcaggatctcgttgtcagtctttcaagctccaaatgtgctcccacttctggactgggttaactgtttgcccaagtcaatccagacctgtgatgccagagagctggcaggagttgcagcgacttttgtcacagctaccagcccctgtggctgttcctgtggctgtttccccttctacccagcatacccattgcacagtatttataaataaaaccttcagaaaggtattcagataacnt

SEQ ID NO: 31734 - DNA, 171 bp, Homo sapiens
  misc_feature 1: n = A,T,C or G
natctgcaggccgaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtc

SEQ ID NO: 31735 - DNA, 158 bp, Homo sapiens
tcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgttgagg

SEQ ID NO: 31736 - DNA, 138 bp, Homo sapiens
  misc_feature 4, 7, 22, 28, 65, 75, 82: n = A,T,C or G
gctntcnacttggacgctgcanaatggntcccgcaaagaagggtggcgagaagaaaaagggccgntctgccatcnacgaagngggaacccgagaatacaccatcaacattcacaagcgcatccatggagtgggcttca

SEQ ID NO: 31737 - DNA, 177 bp, Homo sapiens
gggacgccctggctgtctgcccctctagcagcacaccaccgttccaatcattcagccctttgtgtccctactagtccctgaaatcgcctcagctgagtgatactgggggtgggtggtgagaggggaatgctgggagggagtgacacttggggatccaagacagaggtatcaggaccc

SEQ ID NO: 31738 - DNA, 184 bp, Homo sapiens
  misc_feature 11, 12, 28: n = A,T,C or G
aactccggccnntttatggcccgggccnaggggtttctggttggataattagcagtttagaatggaggaagaaccaacaaagacatgctttccatttttttctttacttatctctcaaaacaatattactttgtcttttcaatcttctacttttaactaataaaataagtggattttgtatttt

SEQ ID NO: 31739 - DNA, 500 bp, Homo sapiens
  misc_feature 8, 24, 30, 39, 40, 41, 56, 74: n = A,T,C or G
tccggccntttattggcccggganggaaanctggggaannnttgccttaagtgccnatccctttgaatgttccnccggaaacactggtggacagattctagtgctgagaagaaacaccgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattgggtggtcct

SEQ ID NO: 31740 - DNA, 154 bp, Homo sapiens
  misc_feature 8, 24, 30, 37, 47: n = A,T,C or G
tccggccnttaatggcccgggganaagcantcttggngacctactgntttctaggctaaagttcacttggcatcaggggaatgaataaaggttagcctgagttattacatgttcaggtagtctctatcattactccataggactttggaaaaat

SEQ ID NO: 31741 - DNA, 399 bp, Homo sapiens
gtgtgcttcttgagcacctgcacacttttcagaactgcaaacagattgaatgttgctgtcctcatttcctgttccacatggattttagcatagttgctttttatcacaggaaccactgaaaacccagctttgcaaagatgtgatgtcatagagatgaatgtggtgtgatgtaatgttgaaaccgtaaactgatttgtgtttgcggttcactaagtgatcaacaaatgtcatgtgttactatttctcttaaaaagttaagatatcccccagtacttctgtgacttctttatggtgtcttggggtgccttgatacacaatttgggacatatagcccttagtactcttttcttgtctaccttgacaccacattttctggtgtacatcaagtgttttggaaga

SEQ ID NO: 31742 - DNA, 422 bp, Homo sapiens
  misc_feature 37: n = A,T,C or G
gttgttccgctggtggcgtcggagcccgagcccgganctggtcaggatgatcaccggacgtgcagctcgccatcttcgcccaacatgctgggcgtgtcgctcttcttgcttgtcgttctctatcactacgtggcccgtcaacaatcccaagaagcaggaatgaaagtggcgctttctccgccccagggttccaggacatagtctgaggcaagatggaggggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttcta

SEQ ID NO: 31743 - DNA, 500 bp, Homo sapiens
  misc_feature 8, 9, 27, 39, 43, 75, 431: n = A,T,C or G
ctcggccnnttattggccggggaaccntttttgtgtccntccngcgtgagtgtgtgtcctgttggcagttaaccntttattcccctcattttctccaaaaccttgttcttgtcccaccccctgtgcctttattgtaaacaccttccataacctatttcaccattcaagttttgccagataaggcatttgatacattaaataactgagtactgtgaagggtaagcccattatttaccttgatttacttaagggagaaaataatattttttggtatttataaaaggaaaggactagtgtcatgggtataatgaaataaaccacaccactgggttatttggagtaaactgactagcatattggattctgatcctaggctttatgttattgggttgaaaggcatgaaatatttagcaagaggccggacagatggntaagattatttacattgcttctaacctctatcccattattatttctgcttccagggttagatgcaaacc

SEQ ID NO: 31744 - DNA, 267 bp, Homo sapiens
  misc_feature 9, 19, 35, 39, 42, 54: n = A,T,C or G
cccgggaanctccggccantctattgggccgggancctnagngcctggcacctntttttaaatacaaaaatgggtgttatttttatttttttttgtaaagtgatttttggtcttctgttgacattcggggtgatccctgttctgcgctgtgtacaatgtgagatcggtgcgttctcctgatgttttgccgtggcttggggattgtacacgggacccagctcacgtaatgcattgcctgtaacaatgtaataaaaagcctctttcttc

SEQ ID NO: 31745 - DNA, 236 bp, Homo sapiens
  misc_feature 10, 17, 45, 50, 51, 81: n = A,T,C or G
cccgggaaantcggccnttattggccgggcctgagtgtttaaatnaagannaagcctgcatgaatgtaatcaaaccattcnaacctggagcctctcctttgcttgtcctctttgcccttcggtaatatgtataaaccttacatcgcgactttctcttaacagctgttgtaaagtttattactttatgtacaactgaagttttgttttagttttgataataaattctttggaacttt

SEQ ID NO: 31746 - DNA, 500 bp, Homo sapiens
  misc_feature 2, 37, 50, 71, 72: n = A,T,C or G
tnccccgggaattcggccattatggcccgggcatgcnagcacctggggancccagttatggcaaagtagannaagcatttgttcatttggagccttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgta

SEQ ID NO: 31747 - DNA, 145 bp, Homo sapiens
  misc_feature 27, 71, 77, 130: n = A,T,C or G
ttattggccggggccaagccacttttncactgttactgtgtcaatgtatcctctctcagaaaggttttacnaatccnaaacattatatgttctctgtgtaacctgaatttcacttatcttttataaaccnagaaaccattaattg

SEQ ID NO: 31748 - DNA, 342 bp, Homo sapiens
  misc_feature 10, 11, 34, 35, 52, 66, 67, 68, 76, 81, 101, 102, 122: n = A,T,C or G
gaatgttctnnttgggagtggtaggatgattccnntttggagatgatagaangtttgaatgtggannnctggaagncggangtaccgggaaggcgaagatnngattagagatgatagggaanttagaagataaaaaccataccttttagaagaaaaaagataaatttaaaccctgaaaagtaggaagcagaagaaaaaagacaagcctaggaaacaaaaagctaagggcaaaatgtaccaaaccttagaaagaaaaatttggaagatagaaacaagatagaaaatgaaaatattgtcaagagtttcagatagaaaatgaaaaacaagctaagacaagtattg

SEQ ID NO: 31749 - DNA, 490 bp, Homo sapiens
  misc_feature 7, 15, 27, 30, 31, 32, 50, 70, 85, 93, 116, 145, 248: n = A,T,C or G
taggggngggtttcnagtttcctcccngannntaccctaaaatttttacnctcaatcccttttaaagaanaatcctgtattttcnaaaagaantcctttcctcctgccagtaaaantcctccgcaggggggaaatttgcccctanttacccctttgaaaagttggttatttgttaacctttttcggcagcttttaataggaaagttaaacgttttaaacatggtagtacctgggaaattttacaaganttttaccctagcacttaaatatgtataaatgtaccataaaagaccaaactagtaagcatgaccctggggaaatggtcagacccttgtattgtgttttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagt

SEQ ID NO: 31750 - DNA, 365 bp, Homo sapiens
  misc_feature 2, 11, 29, 36, 41, 51, 57, 71, 72, 78, 82, 104: n = A,T,C or G
angtccccgangtaaaaataccccccccnattaccnagaantctgtgcccntgcccntaccctcgaaagannaattcnaacnagccaataccaaattaaccctnttggaaaaatctttcctgggttttatgtttgtgtgaaatgcccctttactaaacctggaagatgtgtaagatggaagaagaggttctgctggatatggagaaattggaacccttgtacatgtggaaatgtaaaatggtgcattaggaaaacagtttcaacggtcctcaaagtggtaaacatagagttacccatatgactgagaaattttactcccaggtatataccccaagataaataaaaacatgttcatataaaactcg

SEQ ID NO: 31751 - DNA, 461 bp, Homo sapiens
ggcttcttcctttccaacttggaacgctgcagaatggctcccgcaaagaagggtggcgagaaggaaaagggccgttcctgccatcaaccgaagtggtaaccccgagaaatacacccatcaacattcaccaagccgcatccatggagtgggcttcaagaagccgtgcccctcgggcccctcaaagagattcggaaatttgccatgaaggagatgggaactccagatgtgcgcattgacacccaggctcaacaaagctgtctgggccaaaggaataaggaatgtgccataccgaatccgtgtgcggctgtccagaaaacgtaatgagggatgaagattcaccaaataagctatatacttttggttaccctatgtacctgttaccactttcaaaaatctacagacagtcaatgtggatgagaactaatcgctgatcgtcagatcaaataaagttataaaattgc

SEQ ID NO: 31752 - DNA, 105 bp, Homo sapiens
  misc_feature 2, 31: n = A,T,C or G
antgtcaagagtttcagatagaaatgaaaancagcctaagaccagtattggagaagtatagaagatagaaaaatataaagcccaaaaattggataaaatagcacc

SEQ ID NO: 31753 - DNA, 305 bp, Homo sapiens
  misc_feature 270: n = A,T,C or G
catcaaacgagcaactttgtttaggccaaggtaaggagcggaagtagggcaactcggtcctgcgattattaatcccactccccacttattctagggcacacaaacactattttacttttttaaaatcataaaacggcagaacagatttggttagtttagaagaaaagaaagctctataaatataaatctatattcctgtatttttatttaataatttataaataccaagttcatttgacttttatttttgtgtaatatgtaatgatcgtnttaaaaacaataaataaagcccagaagtttaatga

SEQ ID NO: 31754 - DNA, 131 bp, Homo sapiens
  misc_feature 2, 13, 39, 47: n = A,T,C or G
cnccctgggaaantcggcaatttatggcccgggcattcncaccgagnaaaaacccctcatgttcatacaccctatccccccattctcctcctatccctcaacccccgacatcattacccgggttttccctg

SEQ ID NO: 31755 - DNA, 108 bp, Homo sapiens
  misc_feature 10, 18, 36, 40, 51, 80, 89, 93, 97, 103: n = A,T,C or G
ctccgggccnatttaatnggccccgggccgaactcnttantcgggtgggancaacttccgggcttccgtggcggtccgantgaaagaancgcntgcntagccntgccg

SEQ ID NO: 31756 - DNA, 435 bp, Homo sapiens
  misc_feature 9, 10, 39: n = A,T,C or G
ctccggccnntttatggcccgggatattttggtaatttnaaaaatacctcagtaatatgttgttattaatgcaccagaagggatgcgtgtgtctaaatgccttagatttgcttgctttgtcttaggtttggtgtgtctttttaaacttgggaatctaggtatatgctcttaaaaagtacttcttggggaattagaaaagatttctaagataagacattgattttgttatcttagcagtgtaatcaaaacaaatattataacctcaggactaattcttaatgaactttgctgaaattgaaagttgttgctgacaacttaagagcatttcttctcatcgtcatcagccattatgaacgcccttgttttcttgctgtcagctgtttgagattgcatgaatgatgttaaaattatggttcagtcttctgagtggttttg

SEQ ID NO: 31757 - DNA, 219 bp, Homo sapiens
  misc_feature 9, 10, 34, 48, 50, 51, 84, 124, 137, 163, 192, 213: n = A,T,C or G
ctccggccnnttaatgggccccgggccgaactcnttagtcggtgggantnnctcggcttcgtgccgtccgatgaaagaaacgcnagcctagcctgcgaagaaattaattgtgaaattgcaggancaccattgatcantcgacactttcgaaaccgcacctttncggcccccgggttcctcccggggctaccncctgtcctgagccgtcgcttncccgat

SEQ ID NO: 31758 - DNA, 498 bp, Homo sapiens
  misc_feature 13, 21, 36: n = A,T,C or G
cgggaattcggcnttatggcnggattgtctaggtcngcagttataacattagaacccctagactagcatggtaggaaggacctctgaagattgttttcaactcattcacccaaatgcacacaaacacacacagacacacctgcttacctattcacacacgaacaaacatacttcccacatgtgctgaaaatctgattcttgtatgaactttccattcagccactgctgaacttacgcatcaacagggacctcactattccgtaatggttattatgaagttcttctttgctctgcagatctataaccagtgagcacacctctatgtcaaggaccttgcaggaccaaggcaacacagagtcgtagacctactcagaaaatctctgcaactttcaaccacagctcacagagaacaaatcttcttccacagatattcaaatacagtcgtcacctatgctgaagtcttatctccaagctggttgcaattatattaagtactac

SEQ ID NO: 31759 - DNA, 203 bp, Homo sapiens
  misc_feature 13, 20, 27, 33, 46, 60, 113: n = A,T,C or G
attttttttaacnaaggccnaaaagantaaaangtttttgggaacnaaatgaaaccttantaaagtggttttatattaaaaccatcaattgtcttgtatattttggataagcnagcagtacccagcctttcatttgtaacagtctgtggcattgggaaaaaaggagtctgtgattgttgaagtgaattatgttataaatgccc

SEQ ID NO: 31760 - DNA, 353 bp, Homo sapiens
  misc_feature 2, 11, 36: n = A,T,C or G
tngccggggangtttgtttagttttgtggtttgganatgttcatcaacaattacataatagtactgtttttgtctggatccatcatagtcacagaatagcccttgcctgatgtcattctgttaagttgtttttattcagcagaagaatgccaaggccctagctaagagtatcaggccagctctcgaatgtgggtctacttttctgtttcttaggaacatataagaatctttctcagctgggagcggtggctcatgccctataaacccaaccctatgggaggccaagttgggaggatcacttaagccagggaggtcaagaccagcctggaaaacatggggaaaccctgtctcac

SEQ ID NO: 31761 - DNA, 268 bp, Homo sapiens
aagtaaaggcagaaaagattatatgtcataccctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcga

SEQ ID NO: 31762 - DNA, 422 bp, Homo sapiens
  misc_feature 6, 51: n = A,T,C or G
accccngggaattcggccattatggcccgggcattgtaaagtatcaagacnatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcctttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagac

SEQ ID NO: 31763 - DNA, 440 bp, Homo sapiens
  misc_feature 160, 322, 358, 378, 398: n = A,T,C or G
atgatataacaccattcattctgagagctgtccttttgccacttttgccacattctgttggttaaaagtatgttgcagctcctgccagtattcaaaggaaagagattactcaaagcattgaacactagaaggctggaatgactggggatcgccgtggggnctcttgccacaaaggtgaaatgaaaacatttccaaataaacagaaacagagtttctaacgaacagatcttcattaaagaaaattttgaaagatgttctttaggaataaagaaaatggcatgaaggatgactaacgttcaaaaacaatggtgaacaaatcagnacatatgttgtaaattcattatctattgctgcatancaaattgcttccaaactcancagcctaaaacagcaaacgnttgatatttcacacagtttctgagggtatggaatcaggggag

SEQ ID NO: 31764 - DNA, 361 bp, Homo sapiens
gactgctaggggcttaagcggaggggtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaaga

SEQ ID NO: 31765 - DNA, 472 bp, Homo sapiens
  misc_feature 51: n = A,T,C or G
gctaaacctagccccaaaccactccaccttactaccagacaaccttagccnaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcctggttgtccaagatagaatcttagttcaactttaaatttgcccacagaaccctctaaatccccttgtaaatttaactgttagtccaaagaggaacagctctttggacactaggaaaaaaccttgta

SEQ ID NO: 31766 - DNA, 479 bp, Homo sapiens
  misc_feature 6: n = A,T,C or G
aaaatnagaattttagttttgtaagaagtaatagaaattcagtgggtaccttctcattttacaagtgagtaaaaacctaaatgctaaagtgcagttcacagtttagttgtgaatcaggactttaatgcatggctttggtgtcccctgtgctgttccttttaccacattgcagtgctgctcagccaggctatatttataaaatatttttagctttctgcaagctctaagtcttgataggaaataaaagacaaaataacatttttctttaaaaccttgatctttagaatgcatgccaggaaaaataagtgagaaggtcagttattatatacagggacttgcattcatagattaagcccagaaatatttttaatactaatgtaataacaacaatttacatggtgcttcttgtggattagccgtgctcttctaagaactacacgtttttaatgcttataacaaccctatgaaaacaggtactg

SEQ ID NO: 31767 - DNA, 209 bp, Homo sapiens
  misc_feature 6, 14, 39, 68: n = A,T,C or G
agcccnccaatgcnaatatacctttttaatccctcaganagcccctgcaaggtggaatatttacttantttcagttttaccattattgaagaacatttaaatgaatagttcaatatatcatagctgattagtgctagtgctgccatttgaaccagagttcaagctgtttacccaaagtaagttgccatgagtggagagaataattaatc

SEQ ID NO: 31768 - DNA, 497 bp, Homo sapiens
  misc_feature 9, 10, 39: n = A,T,C or G
aattcggcnnttatggcccggggaggcattgaggcagcnagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgatt

SEQ ID NO: 31769 - DNA, 183 bp, Homo sapiens
  misc_feature 15, 29: n = A,T,C or G
cgggaaattcggccnttatggcccgggcnaaaaaagtagccttcaaggtcctctagtttaatatatttaaaaaattcagaggctaatgctcttatcttttaaaatgtcaacttgaaaaaaatggaagtcatacttctctcccaagataaggagttatatctgacttagataattttttctgtg

SEQ ID NO: 31770 - DNA, 490 bp, Homo sapiens
  misc_feature 3, 16, 38, 468, 489: n = A,T,C or G
ccngggaattcggccnttatggcccgggaggaaaaganctacctgaaaaatataaatccttataggacttcaatgaaaagacaaaaaactgagtgtttcttaagagcaggcagtgtcttctaattctttgggtctgattcagccatgattggtataggtagaatcttaatatctgatgactaaatggatgaatcactgcaattattgtgaaaatgttttattcatcatttaaaaaaattaaatgtctgtttttaaaaattaagtttgtgatgacacattgcatactcttcacagtggtggggttaactcagagggatatgactttagctcagggccagcccaaaatacaccggggaaaaacacagaaagctagaatgtttggattatctaatatctgctagatgttagatgctagtacatccactgttgtgggcaagccgcagaacagctcagggaggaaggtatagntatgcctgttttgcagtttang

SEQ ID NO: 31771 - DNA, 479 bp, Homo sapiens
  misc_feature 3, 11, 36, 432: n = A,T,C or G
aanttcggccnttatggcccgggatagtagataccnaataagtataatttcttatgaatttattctctccttagtcctacctgagggaggtttttcaaatacatttttagcccttcaatcattactgctgatcttatcacacataaccaaataggttataatatcctggggctgaattttttaatttgctaccttcctcacctctgaaatatttcttttatcacaggcttgtgtcctctctttaagttcagcacttgacttggctaaggagataaaaatgtatagatctgaagcctctagcaatgattgcacattttgcacatgtcccagggaactcatattcaagtagagcattttttagattcaaagggcaggcttgatgggttactaaaattacttaagttcaacattagatggctttggatgagcagnatttgactcactgggtattctcaggaaaaaatctctacgatagagat

SEQ ID NO: 31772 - DNA, 427 bp, Homo sapiens
  misc_feature 9, 10, 39, 396: n = A,T,C or G
aattcggcnnttatggcccgggaatcaaccttcaaaacnttggctaaaaattactatttacttgtaggtaatagtaatggaaatactcatatccaactccttaaaatgaagatagtttttgccccgatgcaaggtggagatagtgagtaaagtgaaagcacgatagtagaagaaattataatgagatatagagcctgtggtccgctctgaaagagaaagcctaaagatttatagtttatttttgcttctaaagagtataattttatttgattggatcttttgaatcattttgaataatggattaggccaatcccaagacattcatctaaaggagaattttcttttattgtaggtttgtacacaaataataaagttacatactattagtggggttgngaaagaaaagtattttgtgtctaaattaatg

SEQ ID NO: 31773 - DNA, 277 bp, Homo sapiens
cggcccggcgccctagcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtagccaaatgcctcgtcatctaattagtgacgcgcatgaatggatgaacgagattcccactgtccctacctactatccagc

SEQ ID NO: 31774 - DNA, 299 bp, Homo sapiens
  misc_feature 3, 16, 65: n = A,T,C or G
ccngggaattcggccnttatggcccggggagttcaagtaccccaaagtatgtctaattcctaatntagtcctaaagcaaagaatgcattttaaaccttgctaaccccgtggtaattaaaagtaatacttgaaaaactgatgcccctttttaatatgtgactctgtatacagagagtgagagagagatagaaaagctctttagaaaagtgactcattttcatttgattttattagacttgaatttgagaggcaacagcgtgaagaacttgaaaaattagaaagtaaaaggaaactcatag

SEQ ID NO: 31775 - DNA, 150 bp, Homo sapiens
  misc_feature 2, 10, 149: n = A,T,C or G
anttcggccntttatggcccgggatccccttcctgctctgagcgctcacccctgctgaggctcagccccctcaacccggtggcattctgggggaggagtggggcccacagctctccagcacccggaataaagcccgcctgccccagtcnt

SEQ ID NO: 31776 - DNA, 500 bp, Homo sapiens
  misc_feature 2, 18: n = A,T,C or G
tncccgggaattcggccnttatggcccgggcctcaccacagtatagctccagaggccctagcagtcctgctcccacagatcccacttctgacagcatctattaaaagaaaatcttcagctgaattaaatttaaaggaaccttaattgagcaatgaatgattcacgaatcaggcagcccccagaatcacagcagattcagtgagactccagcacagacacatggtggaagatttatagacaataaagggaacatgatgtacaaaaatctgaagtgaggagtgaggtctagaagcaactgggtccattacagttctcagcagtgaggtccagaaacaactggactggttacagtgctcagcatttgccttatttgaacacaactgaacactcagcagtgtgtgagtggcagaagtttggctgttggggattggccaggactcagctactgttttaggcacatactcctaagttaggttttcagtctttctacctattaagtt

SEQ ID NO: 31777 - DNA, 500 bp, Homo sapiens
  misc_feature 6, 36, 47, 205: n = A,T,C or G
accccngggaattcggccattatggcccgggtggcncgagtggagtnctggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgncgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgcttgagctgaaggaaaagattgatcgccgttctggtaaaaagctggaagatggccctaaattcttgaagtctggtgatgctgccattgttgatattggttcctggcaagcccatgtgtgtttgagagcttctcagactatc

SEQ ID NO: 31778 - DNA, 458 bp, Homo sapiens
  misc_feature 8, 293: n = A,T,C or G
tccggccntttatggcccggggtccgttattagtttgctgaatattaccctagtgattattgagtatttattctcaccctttcagacatgagcttctgaattcaacacgtgaagatttacagcttgataagccagcttcaggaggtaggtcttcaatctcgaggcagatcacgaagattatgtgcaataattatttcacgcttaacattgatttcttctttatgttaccttccacatgaaataatatgtctctaactattaattatgtgccattacaggagaattcatgttgncaaaattctaataatttctagaagaataaacgcatcttctttttattaacccattgtaaatacttataaatattgcatttatggggtagaccagaagtaaaagaacaatatttgttctacttttgatgcaagatttatctggcataatgcattgaacagtttatt

SEQ ID NO: 31779 - DNA, 497 bp, Homo sapiens
  misc_feature 1, 11, 27, 38, 65: n = A,T,C or G
naattcggccnttatggcccgggaatncaaattcagtnaatggatgttttctgtcttcttcttcnactaggttagagatataggaaccagattaaccatgcctcataaacaactagaaagccagagaaaatatatgagacaaaggtgttcaaacattggacaaatgaggagagcccacagtgactgtccacagctcactatctggtgagacaaagaactcaggcagaacttggcagtctctccgagttaaagaaacaaacatcaaggttcagggatgccaaggcaggtaaatatatttgcagcactggaaagaatagcttttcagagggagagacagacagagagaaaaactaactctttttcactagaaatctgcagattgtgttcatcaggtcttttctgaatactaatcagtgcatatgtatgtaaactaccaaagccaggtaaggaacctttggaaaagagctaacaggaacaataatcctcagttctcacct

SEQ ID NO: 31780 - DNA, 412 bp, Homo sapiens
  misc_feature 1, 398: n = A,T,C or G
ngaccccgggaattcggcattatggcccgggcatcttttcatatgttactggccttctgtgagttgtatatttatatcctttgttcattattctgttgtacatgtcttgatttgtaggcgtactttaaatattctggatactacagtctttttggtcgtgcgcatcataaataattggtgccacactttgggtttttggtctcgaactcctgacctcaagtgatctgcccgcttcggcctcccaaggtgctgggattgcagacgtgagccaccgagcccggcccagtttaaaatattttctaatttcctttgtgatttcttccttgttacatgggttatttaagaaaggtgtattaggctccatgtatttgaggatttcccaagtctttttctgttgntgatttctaattta

SEQ ID NO: 31781 - DNA, 472 bp, Homo sapiens
ggatcgggagtggcagttttactgttgtcgctacagcaagaggtgcccatattcctgctggctaacaacagaatatccaggtcactatggtgaggaaatggacatgatttcctacaattatgattactatatccgaggagcaacaaccactttctctgcagtggaaagggatcgccagtggaagttcataatgtgccggatgactgaatacgactgtgaatttgcaaatgtttagatttgccacataccaaatctgggtgaaaggaaaggggccaggggacaggagggtgtccacatatgttaacatcagttggatctcctattagaagtttctgctgctctctttccttctccctgagctggcaactgcaatgccaacttcctgggcctttctgactagtatcacacttctaataaaatccacaattaaaccatgtttctcacttttcacatgtttcatagcaactgcttt

SEQ ID NO: 31782 - DNA, 470 bp, Homo sapiens
  misc_feature 443: n = A,T,C or G
agtcagacctgagtgaaaacagcagatggtgatagtaaggagcagtgattttaatcaataaagagcctgacattgacattcagggataagagaaaatactggatcaggccacagaaaggtaatctaggatcttgttcaaagtgtggtccatagcaacatcagtttcacttgggagttactgagaaaggcagaatctctgcagacctactgaacgaggatctgcattgtaaaccatttatcaaggctgggcatggtggctcacacatgtaatcccagcattttgggagcctgaggcaagaggatacttgagaccaggatttcgagaccagcctgggctacacggtgagaccccatctctacaacaaattaaaaaattagccaggcatgctggctcatgccttgtggtgccagctaggaggatcccttgagctaagaaggttggnggaccaagtaaggaaggatcccttaag

SEQ ID NO: 31783 - DNA, 466 bp, Homo sapiens
  misc_feature 8, 26, 38, 39, 88, 405: n = A,T,C or G
tccggccntttattggcccggggaantgattctaagannttggtttgggatcaataggaaagcatatgccagcccaacccaagatgcnaaatgttttgaaatgatatgacccaaaattttaagtaggaaagtcaccccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtatttgaaaacacttagtatgcagttgataagaggaatttggtataattatgggggggggattatttttttatactgnatgtgccaaagctttactactgtggaaagacaactgttttaataaaagatttacattccac

SEQ ID NO: 31784 - DNA, 123 bp, Homo sapiens
  misc_feature 5, 16, 32, 47, 68, 70, 71, 84, 94, 112: n = A,T,C or G
gattntaattttaaanggaaaacctacaactntaaacctgctaaaanaaagcataggagaaatttttngnngcttttaattgancaaacatgtnttaggtaaagcacttaangcaaaatctac

SEQ ID NO: 31785 - DNA, 472 bp, Homo sapiens
  misc_feature 26, 68: n = A,T,C or G
gtttctcagcccatttgatatcttcnggatttttctacagttctccacttctgtttattttggaaccnagttgaatatgaataactattgcagacaattgttttcagctatttcagatgggaaagaataaggacataggttttaaggagagctaatgcaggtatgtggaaggttacttttattggcgttcattttcccaaatttccaaatatagcagactctcctagtgtcttggtttactgcctctaggttgctgtttgaacaactggagaaggatgacatggacagagagaagggggaattaaagggagttatgcaggccagcagaggaagaaatgatcccttttctgcttgcacaggaggaagaaatttatgaccctcatccttttaaatgatagcctgaacgctgggctgtagaatcaaatttataagtcattttgaaaatctttcttttggcttcacctgactatat

SEQ ID NO: 31786 - DNA, 466 bp, Homo sapiens
gagaagtgtcgattccctgttaacatggatatcatttctgcctcacatttcccacttgaggttgaggcgtactggagacaacacctcagaccatctgaaccccatcagtggatgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttattttgtatcatctctttgtctaggaat

SEQ ID NO: 31787 - DNA, 337 bp, Homo sapiens
  misc_feature 15, 17, 19, 20, 26, 30, 67: n = A,T,C or G
tatggccgggagagnananntacccnggancattattcacctctattcatcctagcaccggaagccnaatttgggtctaaaatcttgtgatggcaacccaggagccttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcat

SEQ ID NO: 31788 - DNA, 236 bp, Homo sapiens
atacctagagtgggataatgctttatagcgcccccacaaggaaggggttgctgacaactctcgattggtgctgagtatagcagtctgctgtaaacgacagtgatgctgaacgataacttgaagcagctttccaaactcgttagtggtgtggactgattcttcgctgtgtgtgtgctcacatcagcgccttcattgttatcgggattgctgtcctgatttgtaaatcgaggagctct

SEQ ID NO: 31789 - DNA, 341 bp, Homo sapiens
  misc_feature 8, 31: n = A,T,C or G
ccgggaanttcggccattatggcccggggancacgcttttcatctgtcccgctgcgtgttttcctcttgatcgggaactcctgcttctccttgccctcgaaatggaccccaactgctcctgctcgcctgttggctcctgtgcctgtgccggctcctgcaaatgcaaagagtgcaaatgcccctcctgcaagaagagctgctgctcctgctgcccctgtgggctgtgccaagtgtgcccagggctgcatctgcaaagggacgtcagacaagtgcagctgctgtgcctgatgccaggacagctgtgctctcagatgtaaatagagcaacctatataaacctgg

SEQ ID NO: 31790 - DNA, 417 bp, Homo sapiens
  misc_feature 34, 37, 378: n = A,T,C or G
tatggccgggcattctagtgtatttttcatgccnganattgtggttttaatcaccagaagtttgatttggatgttttcatatcttccacgcctctacttatctttttaaatgtctttgatacatttaaattgttccaataactattttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgtgtactggatattcttctatttctggaatggngttcctgagctctgctctgggattccgttaaatgatgtg

SEQ ID NO: 31791 - DNA, 479 bp, Homo sapiens
  misc_feature 416: n = A,T,C or G
acggtaccttattctaattgctgtggaaaagagttaagacttttgctttaatttcaattaaaatgatggcactgcaattcaattctgctctaaccttcatgagattacgataaaacatccagttactagagtaaacttgctactgacaatagtattttacttctatcatttgtggcatttaacagataccttgtttggcacaaggttataatgatttgcatcactgcagagtctgtaagatcagaaagaagttcctgagaaactaattttattaattaaattatattactcaggatgcttttctttgaaatgcccagaaatctaagttattctgcctgtaatttcataatatgaatgacattggcatgtattttttaaaaggaataaccccaagtaaattatttttcaaacttggntactctttaatgtttacttcataaaggagagctgaacctgattttacaaaaagatggtgaaat

SEQ ID NO: 31792 - DNA, 282 bp, Homo sapiens
  misc_feature 7, 17: n = A,T,C or G
cccgggnaattcggccnttatggcccgggaattctaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttgat

SEQ ID NO: 31793 - DNA, 237 bp, Homo sapiens
atattttgtacatgaattacttccggaaaaggtcagttcaatgtttaaagatttttcatacaaaataactaaaacagacctcttaggaattgcccactcctcacccctgttattaataccctaagtctatttgttaattctctgctgttgttttaaatatttacaaatttccctatccttttctgtgccgtttcaaaatataaacttagtttttcttaacctgaaaccttagatagt

SEQ ID NO: 31794 - DNA, 495 bp, Homo sapiens
  misc_feature 5, 15: n = A,T,C or G
cgggnaattcggccnttatggcccggggttagggcaccttgaagttatctgtgctggagattgaatagattttcagtgatggagatctggggagagcattgtccctcagagctgttgaaaagtaaaaaatctttctttttcaaaaattaaccactaaagaagtttatgattgttttctctctctttacttcacggatattttgaaaatacagattttagttcttagtttggcaagttgtttagcttctggggagagggtcctgtggacagtggcagcttaggaagcaactggaggtaggcctctaggagtcctgtgtgaggcttctcagaagtgccaggtgatgctctcataccttggaggtgggcatgcagcccccaagattgtgaaggagtggctcagtgggatcagagagacaaaaacactactggacactttcagaaattttctggtcaaatttcatcatgagctatttgcccagattagttttcttcacc

SEQ ID NO: 31795 - DNA, 435 bp, Homo sapiens
agtgaaggaaggatgctgcaggaccttctaagtgatcgaaataaacaagtgctggaacatgaaatggagattcaaggcctgcttcagtctgtgagcaccagtgagcaggaaagccaagctgctgcagagaagttggtgcaagccttaatggaaagaaattcagaattacaggccctgcaccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggcg

SEQ ID NO: 31796 - DNA, 314 bp, Homo sapiens
atatgcaccccgatataggagcacccagatttataaagcaagaccttagagacctacaaagagacttagactcccacacaataataatgggagactttaacaccccactgtcaacgttagacagatcaacgggacagaaagttaacaaggatatccaggaattgaactcagttctgcaccaagcggacctagtagacatctacagaactctccaccccaaatcaacagaatatacattcttttcagcaccacaccacacctattccaaaattgaccacatagttggaagtaaagcacttctcagcaaattcagc

SEQ ID NO: 31797 - DNA, 492 bp, Homo sapiens
  misc_feature 2, 44, 46: n = A,T,C or G
tnccccgggaattcggccattatggcccgggtgcccgtgtgaancntgtgactttgtccagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtgggggagcagaagaattctcttatccaacatcaacatcttggtcagatttgaactcttcaatctcttgcactcaaagcttgttaagatagttaagcgtgcataagttaacttccaatttacatactctgcttagaatttgggggggaaaattttag

SEQ ID NO: 31798 - DNA, 193 bp, Homo sapiens
  misc_feature 6, 47, 60, 70, 75, 106, 108, 139, 167, 174: n = A,T,C or G
tacccngggaattcggccattatggcccggggcctttttttttttanggcggccgggaanatggcggacnttcanactgagcgtgcctaccaaaagcagccgaccntntttcaaaacaagaagagggtcctgctggganaaactggcaaggagaagctcccgcggtnctacaanaacatcggtctgggcttca

SEQ ID NO: 31799 - DNA, 222 bp, Homo sapiens
  misc_feature 222: n = A,T,C or G
attcacacatgtgtgcacctgcaaaggttggtggatttgtctctcaaaaaactataccgcctaaggtaaagggaacctaattgtgacattaaagagcccctcttaaccactgccacctgatcagcactgcctacactctttagagctgccactcacatgtttgtgcctgacacaattaggtacagccattgtgggaagccttcattgtaaaatacagaacan

SEQ ID NO: 31800 - DNA, 400 bp, Homo sapiens
  misc_feature 5, 345: n = A,T,C or G
gtttntggcagaaaaagcaaaatccttaacagttcaacagttggtcaaaagatttgcctgaatacatgatctaattttaagtattcctgtatagtagctgagctgctattgaagggctccttctagccctatgttttcataatatctgtggcttatatttatggaatagttaatccatgaactatcctagtaagctgttgactagaaatgagctgctcttacgcttaattaacttataaaaatgaaagaagattaaaacaatggtaattgctctaaccatttcttgttatctttcattcctaggtggtactttgctgttatctctgtttctggggtttttgcagngactttttctgtggtatttgcatacgtagcagatataacccaagagcatgaaaga

SEQ ID NO: 31801 - DNA, 444 bp, Homo sapiens
  misc_feature 12, 18: n = A,T,C or G
gtatatttgatnattttnttcccaccattgcattacaacctctaacttaaatgggtaaccctaaggcatatcaaagaagcagattgcatgataaacggaaacagaaaaaaagaacctacatttattttgctttagcatccttactctcaccttttatgagattgagagtggacttacatttccttttttacattttcgtatacttattttttttagccatcattatatggtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaatttt

SEQ ID NO: 31802 - DNA, 474 bp, Homo sapiens
gctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtaccccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcat

SEQ ID NO: 31803 - DNA, 329 bp, Homo sapiens
gataatagttggaaatctggaataacaagaggtcattctcaaggtgagaagtgagggggaaaatttaagacagtcaaactgctacctcaagaaatacaatagaggtgagagtgaattttgaaattaaataaatggcatgtaattgatctttattttcaaaggagcaggtgttcttggtaggaactacatgataggtttaattcagcagttgaggttgccaggcctcacttagtggagaagagcaaaagcacgagaaggtcatcttctgggttttgagaatacaacacttcaggctctattatgaaccattcccttcctcttccattctt

SEQ ID NO: 31804 - DNA, 472 bp, Homo sapiens
gagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatcccgggcagagggcaatagcaggttcacgtacactgccctgaaggatggctgcacgaaacataccggtaagtggggcaagactgttatcgagtacccggtcacagaagacctcacgcctccccatcattgacattgcacccatggacataggagggcccga

SEQ ID NO: 31805 - DNA, 456 bp, Homo sapiens
ctaaaactttatgtacaaaaacaggccagagttggcccataggccacagttttccaacccctggtttacataatagagaaatggaattgaaaaataaatgtgattaaattatctgaaaataaagtgttaagataattcatacccttctccttttaaaagtagtaacatgggccaggcacggtcgctcacgcctgtaatcccagcactttgggaggcggaggcgggcgaatcacttgaggtcaggagttcgagatgagcctggccaacatggtgaagccccatctctaccaaaaatataaagatttgcccgagtgtgggtggctcgcgcctgtgatcccagctacttgggaaggttgaggcgggaagaattgcttgaacctgggaggtggaaggttgccggtgagccgagattgcaccactgcactacagcctgggtgacagagcaagacttcatct

SEQ ID NO: 31806 - DNA, 435 bp, Homo sapiens
atatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgtaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttacttgttgagaagtgtgaccaaaagttacatgtttgcacctttctagttgaaaat

SEQ ID NO: 31807 - DNA, 227 bp, Homo sapiens
  misc_feature 36: n = A,T,C or G
gattcttttctcccccattatgcccctatatatatnaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtgactataataaaaagcataattttctcattctgtc

SEQ ID NO: 31808 - DNA, 468 bp, Homo sapiens
  misc_feature 454: n = A,T,C or G
ggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggcttgaagtccaacgtctctgatgcggtggctcagagcacccgtatcatttatggaggctctgtgactggggcaacctgcaaggagctggccagccagcctgatgtnggatggcttccttg

SEQ ID NO: 31809 - DNA, 156 bp, Homo sapiens
  misc_feature 22, 135: n = A,T,C or G
ggctgaataccagtttccgagncggcaaggcatgcgatggcgatttttagtgtgtatgtggtgaacaaagctggcggcttgatttaccagttggacagctacgcgccacgggctgaggctgagaaaactttcagntatccgctggatctgctgctc

SEQ ID NO: 31810 - DNA, 170 bp, Homo sapiens
ggcctttattaaaaactgagtgactctatatagctgatcagttttttcacctggaagcatttgtttctactttgatatgactgtttttcgggcagtttatttgttgagagtgtgaccaaaagttatatgtttgcacctttctagttgaaaataaagtgtatattttttct

SEQ ID NO: 31811 - DNA, 416 bp, Homo sapiens
  misc_feature 5: n = A,T,C or G
aaggngattacaaacaaatatttgaagctctttgaggaggggcttttcagatttaaagtgataaaccttattagtctctctttaggcagagaactgaagatacatgtatatctcaaacttgtgagtgaaattctctttcagactttaacattgaaaagttaatttctaattctttctcatatattcatggcattgttaatgatgtgccgaagatgtcctgtaacttgagaaaggagaaaattatatgatataagtttagttgagagtcttagaaaattctggttccctgtaacactagcctacccacatggagtaagtcaagttatgggagttctgtttgccataacctaacttttgtgtattacaattttcagaacttgtttgccaccagaacaagttgtcttgtcaaaaattac

SEQ ID NO: 31812 - DNA, 465 bp, Homo sapiens
caccgccttgatggacgcaatccagtgtggtcacatcgacgtcgctaggctgctcctcgatgaacatggggcttgcctttcagcagaagacagcctgggtgcccaggctctgcacagggcagctgtcacagggcaggacgaagccatccgattcttggtctctgaacttggcgtcgatgtagatgtgagagccacatcaacccacctcacagcacttcattatgcagctaaggaaggacatacaagtacaattcagactctcttatccttgggagctgacatcaattctaaagatgaaaaaaatcgatcagccctgcatctggcctgtgcaggtcagcacttggcctgtgccaagtttctcctgcagtcgggactgaaggattctgaagacatcacgggcaccctggctcagcagctcccaaggagagcagatgtccttcggggctctggccatagcgcaatgac

SEQ ID NO: 31813 - DNA, 340 bp, Homo sapiens
  misc_feature 14: n = A,T,C or G
cattctttataacnttatgaattcccacctagtttgagaaccactacttttgtatggtttccaccctttgtgtgatttcaaaaaggctcgcctttaggcaaaatttagcaagaagtcaagccaatcaataattgcttgaagtcaacttttccagaataaaactgtataagggactttgaatttgaaggttacaatctaaagtttgctttgagatgggaataatacgtagtgttggggattattgtaaacctaagtgatctaattggaaattagaattgaaagtgggaaagtgaaggaggaaaaaatgaaggttggggagaaaagaaagcaatttaggaga

SEQ ID NO: 31814 - DNA, 394 bp, Homo sapiens
attcaatatatattataaattaatataaatttaagggaagctctatgtaaggagacttagagccaaactgtttaagctgtatcatcccaacaaagtatcctttcatgaacggggcatgcaatagcttaagaattgctaggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgcctttctga

SEQ ID NO: 31815 - DNA, 187 bp, Homo sapiens
attctaacataaaactttagtatgtagctgtttgattcaaagcctaggtggcttaccagcccaagtccccatgtttggactttcagctgactagctcatcttgggaatcatttggtcattcagcacatttaccaagtatttactatgtaggcatgttaaactccaataaaacatacagcattgaacc

SEQ ID NO: 31816 - DNA, 105 bp, Homo sapiens
  misc_feature 6: n = A,T,C or G
gatcanaactctcacagaattgccattgtctgatgagaggaatgagttaggagcatatttctggtggaatagcactctctgttgaagctttcctgggactggctt

SEQ ID NO: 31817 - DNA, 167 bp, Homo sapiens
  misc_feature 31: n = A,T,C or G
tatcttaggagtttaatttgcccttctcttnccatcttccctcagttcccataaaaccttcattacacataaagatacacgtgggggtcagtgaatctgcttgcctttcctgaaagtttctggggcttaagattccagactctgattcattaaactatagtcaccca

SEQ ID NO: 31818 - DNA, 225 bp, Homo sapiens
ggcaccctagtaagcctgcccacgattcctaggaaggctggcagacaccctggaaccctggggagctactggcaaactctcctggattgggcctgatttttttggtgggaaaggctgccctggggatcaactttccttctgtgtgtggctcaggagttcttctgcagagatggcgctatctttcctcctcctgtgatgtcctgctcccaaccatttgtactcttc

SEQ ID NO: 31819 - DNA, 452 bp, Homo sapiens
ggtgagcagtggtcacactgctaaactggcctggagcagcaggaagccttggcacaagcagcagactctcccaacacactaaatcctcaacgcagattaaagacccgataaccaaagaattcaggtaaaaatcatggaaactaactgctgactcaggaaaagagcaaaacactaaaattaagttattgacactgattaacacctggatcctggctgctagaactatgaggtctgcctggctttggggccaaacaatgaagcagctcaaatcactgtcgtcttctttgactttcttactctaagatcttctcatgcatactgcttatctcactcacacaaagcaggaaaagggagaatttaaagccaggtgccggtggtgcacgcctttagtcccagccactcccttgagtccaggatcgctgcagccatggtgatatagcaagaccccacct

SEQ ID NO: 31820 - DNA, 382 bp, Homo sapiens
  misc_feature 8, 30, 38, 42, 49, 51, 58, 65: n = A,T,C or G
actcttgnctcgagcaagcttatgcttgcngaacgcanttcnagctcantncggccgnttcgccntatagatgagaaagtccagtggatggactttcaagtttttgaggtttgattgtgggatattgagggaaaggggaacttgggctttctcttaaatttcaagctattgttgattatcaccaaataagaatacaactgtaggatgaaccgtttaaatgaggaaggcaaataacaaattgtgttttggacagtttgagttttaggtagctatgaaatttcctggtagaattacacaagcattttagttttatgcatgtgaagctcagaaaagaaatgaagctatagatttgcaagtcctcagcctatgtgtagtagccaga

SEQ ID NO: 31821 - DNA, 456 bp, Homo sapiens
  misc_feature 7: n = A,T,C or G
ggaatcngaaggtatttattttaataaaagatgaagagtactaattataaaatctgctaaattaaggcatgtagaaggtactctagagctgtagtaaatatattctctgttttccttggcatgtctgtctaattttcatacaaaatgcagaacactgaaaaagtatgcagaggagtcgtaatggttctattccttctttctgtagagataatgcatcatttattccaattgcagttgttccaaagaaatacctgtattcaggaggaaaacatccttcatgctgagtaaaaaaaagaaaaattattgtttacaaaaatgagctggacatggtgctgcacatctgtagtcccagctactcaggaggctgaggtgggaggatcacctgaacctgggatattgaggctgcagtgagccataattgtgccacagtgctccatggtggacgacagaaagaga

SEQ ID NO: 31822 - DNA, 470 bp, Homo sapiens
gggaggaaagaggaagactaccaggctgctgaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtag

SEQ ID NO: 31823 - DNA, 280 bp, Homo sapiens
  misc_feature 6, 7, 27: n = A,T,C or G
ccggcnnttatggcccgggccttgctnaatctacctttttgttttggttcattgtacccatcacaacatctttactaggaattgtgattacatcaagatctttcatttgagtttctaaaagaataaatgaaaatcaatgcccaataattttcacagcatttgagttcatgtacaaaattattttaagtagtaagaactaagatacaagtagtaagttctgtacatataaagataatatcccataaaaatgcaactcactaagacaaaatatttcaacagt

SEQ ID NO: 31824 - DNA, 153 bp, Homo sapiens
  misc_feature 32, 153: n = A,T,C or G
cgatggtagtcgccgtgcctaccatggtgacnacgggtgacggggaatcagggttcgattccggagagggagcctgagaaacggctaccacatccaaggaaggcagcaggcgcgcaaattacccactcccgacccggggaggtagtgacgcan

SEQ ID NO: 31825 - DNA, 392 bp, Homo sapiens
  misc_feature 5: n = A,T,C or G
aaganctccagtacctagtagttgtaactaagacatgtgagaaggagtgggcagtgatgtcacataactccaagagagtgtttgctccaagtcaaatgaagaaactacagtatctcaataaggaagaagtcattaagggctgtgttacagagagatggaattacctgaagatgttcagcctatatggttggaaaaattatgttgcttttactaagcactggggagtcagaaagaagaggtttggggcagaaggtaatgaatgtgctttatgtcaagttgaatttatgatttgggtgagatcttaagttacttatttttgacttgaaatatgagtgtggaggtcagagctaggtcagaactggaagctgtagatcaagtgtcctgtgaataga

SEQ ID NO: 31826 - DNA, 479 bp, Homo sapiens
  misc_feature 32: n = A,T,C or G
ggcattcggagggaagctgacatccacacctngtcgagacttccagggatgtggccggggagcagtcacatgctgtagctttcatgagcacaggcatcagtcaggcagatgtttgtcgactggaatggcgccaaatcttaagggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactatgtttcaagctgctcaaaaac

SEQ ID NO: 31827 - DNA, 455 bp, Homo sapiens
  misc_feature 14, 16, 31, 34, 58, 85: n = A,T,C or G
cactcggtttctgnanggccccgggacatancanttgcagtttcatgtatgtatatanttcatgctcatgtatatttagttacgnataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggta

SEQ ID NO: 31828 - DNA, 420 bp, Homo sapiens
caattttacaactgaaaacacagaggagacccatgtggtcctaagatcacacggggagttagtaacagattgagtctgagtctgttcttcatcctcagtccccttcaccactgcttttgctaaatccatagaccatcctgtttaaaagcaacactcagggaaacaacgcaaacgtccatcagcaggtggcggatgaacaaaacgtgtcttgtacagacaatggaatattactcagccttggaaaagaatgaaattctgacacaggccacaacatagatgaactttgaacattatgcagagtgaaaaaagccagatacaaaaggacaaatatcatatgattccacttatatgaaagttttcctagaatagacaaataacatagagacagaaagtggattagtggttaccagggcctggggg

SEQ ID NO: 31829 - DNA, 403 bp, Homo sapiens
  misc_feature 6, 30, 31: n = A,T,C or G
gttttncactgcagctgaatgagttgtggnncccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttct

SEQ ID NO: 31830 - DNA, 418 bp, Homo sapiens
gtttggtttgattttatatatatgatgaaagagagagtatagttttattcttctacaaatccactttcccagcatcatttgtttaagatgctgttcttatcctattgtatgttattggcaactttgtgaaaaataagttcactacaaatgtatagatttgtatctggattctctagtctgttccattgatctatatgttcatttttatgccagtatcacactcaatagcatttatgtacaccaacagtgaacaatcataaaaacaaagatagcaatctcatttacaatatagctacaaagaacataaaatacctaagaatcaatttaactaaagaagtgaaagatctatgcaaaaaaataaataaaacactgatgaaagaaattaaaagtggacacaaaattagaaagatattccatg

SEQ ID NO: 31831 - DNA, 357 bp, Homo sapiens
  misc_feature 7, 33: n = A,T,C or G
agaagcncaaaagtaaaacagcaggagaagaantaaatgatcaagattagatcctgtgctgaaagaaaaaccaagaaaaaagatgacattccagaagaagacaaaggaaatataaaacaatgtgaaatcaattacgtaaagaaatttcagagcttccaagaccacaaacttaaaataagtaaagaagggagtaaaattcttaaaaaggctcagaaagatggatttttgcatgaaacacttctggacagagaaccaaattgaaagccgacagatactgcagatgactgggatttttgtttctgtcttatctttttgtgttttttttctgaataaaatattcagaggaaatgcttttac

SEQ ID NO: 31832 - DNA, 473 bp, Homo sapiens
  misc_feature 5, 7, 30: n = A,T,C or G
gaaantnatgttgctcacctgagacccatnggcccacacacagtcattcaaacagccgtcctgtactcacatctctgcagatgaaaaagcagctgaaaggagtcgaaaggctccaccaattcctctaaaactgaagcctgattactggagcgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaaagtggtcctgaagaagctagagtatatttta

SEQ ID NO: 31833 - DNA, 205 bp, Homo sapiens
  misc_feature 22: n = A,T,C or G
atgaaacaatttggagaagatngaagtttgaagtggaaaactggaagacagaaatacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtac

SEQ ID NO: 31834 - DNA, 391 bp, Homo sapiens
  misc_feature 14, 21, 49, 65: n = A,T,C or G
gacccagggaaatntcggttnttatggcccgggatagtttgttgtgccntatacaagacttatantggtgatatgcgatatataaacacaacaaattgtgtttgtttctccaaacagacttggtttcccttacctttttccctaccatgtaactccggttgtcaaagcccatataacaggaaaaaaaaaatcagatatgtgcatataccacggacaaatcaagtgtagtgactacttaaagtacctttcagccataatgagaggtttaaccagctacatcagatcctcatgggccacagatattatttgttaacatgtaagggaaacataagagatgataaccaaaaagtatccgcaggtcaattcatgtattttttaaaaaaattataac

SEQ ID NO: 31835 - DNA, 178 bp, Homo sapiens
  misc_feature 30: n = A,T,C or G
tcctgcaatgcaaagagtgcaaatgccctnctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatat

SEQ ID NO: 31836 - DNA, 119 bp, Homo sapiens
  misc_feature 6, 7: n = A,T,C or G
gaaacnnctagatattctaaatgtgacaaatgaacagcaggattatgaattatcaaaggaaaaagtatttgctgaggtgaaaaaatctgatgtttgaggaagtttttatttttatttat

SEQ ID NO: 31837 - DNA, 231 bp, Homo sapiens
agcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttcca

SEQ ID NO: 31838 - DNA, 200 bp, Homo sapiens
  misc_feature 4: n = A,T,C or G
agangcccagctgtgaccagcaacgtattacagtgctggccaagtgctggggtcatggcagtgcttcagccccattggccatctcaggtgctaggcaagggagctgaagtaggaattcagtcatcttgatgaggctgccggagctgatggaaagaaagggagtctgagactcagcaggcacatggaagatgaataaagtt

SEQ ID NO: 31839 - DNA, 399 bp, Homo sapiens
  misc_feature 6: n = A,T,C or G
ggcacncggcgagtctgggcgactgcgcacgcgcggctggttataaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattggcaactgagccagttttggtatagtcaggaaactgctctgcagctggcacaggaggcaattgcagctgtaggagaaggtggcagaatcgcatgtgtgagtgcccctagtgtttaccagaaactcagagagctgtgcagagaaaacttttcgatatacatctttgaatatgacaaaagatttgccatgtatggagagga

SEQ ID NO: 31840 - DNA, 104 bp, Homo sapiens
cagttttaagttattagtttttaaaatcagtactttttaatggaaacaacttgaccaaaaatttgtcacagaattttgagacccattaaaaaagttaaatgagc

SEQ ID NO: 31841 - DNA, 370 bp, Homo sapiens
  misc_feature 29: n = A,T,C or G
ctatccgagaaagggaaatatgggaaggntaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcact

SEQ ID NO: 31842 - DNA, 213 bp, Homo sapiens
caaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtggaaccttcagaaggaaaggagaatg

SEQ ID NO: 31843 - DNA, 395 bp, Homo sapiens
  misc_feature 1: n = A,T,C or G
ncttttccgtggcgcctcggaagcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagaga

SEQ ID NO: 31844 - DNA, 289 bp, Homo sapiens
atattaaatctttaaaatactctatgactttttcctgcccagcatcttttgggggaaaaagaggaagatgaataaattaaaggtttttttctttctttgtttttttgagacaaggtctcactctgtttcccaggctggagtgcagtgttgccatcatggctcacggctcctggcagcttcaacctccaggctcaagtgaccctcctgcctcagcctcctgagaactgggaccataggcatgagccaccacaggtttggtttttttttcttaataggttggacatatggc

SEQ ID NO: 31845 - DNA, 275 bp, Homo sapiens
  misc_feature 5, 30, 31: n = A,T,C or G
ggcangtaaaatctcacacctaagccctannctgtctctgttgtatcaacaaatacaatataaacggaagccaaatcacaagcaggattcagtgagaggtcagaagcaaatggtagtaatatgatgggatggcattcaggcaggattattctttcaaagcctatttaacatttttattcgttcagaacatctacatgcaaagcaatatttctgataaacaggagacttttgaatgaatgatttttgagttcagtgttcattgaaatgatgtatgc

SEQ ID NO: 31846 - DNA, 100 bp, Homo sapiens
aactgtgtgtgtcctacacaatggtgctattctgtgtcaaccacctctgtattttttaaaacatcaattgatattaaaaatgaaaagattattggaaagt

SEQ ID NO: 31847 - DNA, 379 bp, Homo sapiens
  misc_feature 31: n = A,T,C or G
caggcacgacagctgtcttctcgggccatgncctcttccacctgtgggatcacaggactgtgtccagctgacccaatgagaatggtataagtgctttatctcatagggagttctgagtcaaaaattttggtgttcttgacatgaaagattggcagagtgtattattattccttagtgttctgtgcataattaacaaccacccttaactagacctggtagcccagggaaactggtcagaccagctagtgaaagcaggtggaaaatgacctcgagggaagcacggagtcgggatccacattgagtggaggtgactttgtagtggattagggtgctcataaaaaccgtggttgcagttggtaccagtgtcatctgtggatat

SEQ ID NO: 31848 - DNA, 393 bp, Homo sapiens
  misc_feature 5, 7, 31: n = A,T,C or G
atagnanagtatgtatcttggtcacacacantgcttggaaaaagtaaaagatgtctaaaccataatcttgtaactcataacatctgggctggggcccggggatctaattgtttagagagccccaaaagtggctcagatgtaaagccagggttaagaaccatctgccttggaagatttaagggaaacatataaacttgtacaaaggacacagaagcagtcagttttaattttttagccatgttggtaaaagttcattttcagtacatgggtaacacccaggccctttcccattatatccaggtatgctacaagttcttttaactcttatcagaagttattattactgtttccttagagaggctaccaggctaaaattcacttagtttgggtttg

SEQ ID NO: 31849 - DNA, 474 bp, Homo sapiens
  misc_feature 30, 32: n = A,T,C or G
aacacccgagcgcagcaagtggtacgtgantngcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatgg

SEQ ID NO: 31850 - DNA, 220 bp, Homo sapiens
  misc_feature 10, 12, 38, 39, 42, 58, 60, 61, 62, 64, 66, 93, 94, 97, 125,181, 184, 212: n = A,T,C or G
gagagatcananaggaaagccagaaagaaggcaaaacnnaanaccaaaaaaaacaagncnnnanangaaaaaactggattcagggataaactnncangaaacaaggatattaggttcgtccttgngtgtgagttaaaaaatggaaatgaagtggacttttttaaaaataacatgaaatggnctnttttaaaaataaaatataaattactaanattgactc

SEQ ID NO: 31851 - DNA, 444 bp, Homo sapiens
  misc_feature 7, 30, 31: n = A,T,C or G
gaatctnagttaactttaaatttgcccacnnaaccctctaaatccccttgtaaatttgactgttagtccaaagaggaacagctctttggacactaggaaaaaatcttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactc

SEQ ID NO: 31852 - DNA, 144 bp, Homo sapiens
  misc_feature 43, 48, 82, 102, 114, 123: n = A,T,C or G
agaaaatccaaaggcatgatttattaataaataatattcagcnaagtnacaggatacaggattaaatatgcagaaattggtnatctttcaatatagtatcantgaataaatcanaaatgatgntaagaaaacaatttaattttc

SEQ ID NO: 31853 - DNA, 262 bp, Homo sapiens
tgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaac

SEQ ID NO: 31854 - DNA, 144 bp, Homo sapiens
  misc_feature 24: n = A,T,C or G
tcacccattcattcatccaacaancgttttactgagtgcctactatgtgcctgagatacagtagtgaacaaaagacgggaaagtttcatcttgcccttctaaggagttggattctaggggaggaagtcagacaatatatgtaac

SEQ ID NO: 31855 - DNA, 274 bp, Homo sapiens
  misc_feature 9, 135: n = A,T,C or G
tggtgcagnggctcatgcttgtaatcccagcactttgggaggccaagacgggaggcttgcttgagctcaggagttcaagaccagcctgggcaacatggcaaaacctcatctttacaaaaaatacaaaaaattggntgggcatggtggcacacacctgtagtcctagctacttgggaggctgaggtgggaggactgctcgagcccaggaggttgagactgcagtgagccatgattgtgccactgcactctagcctgggcaacagcgagatcctgt

SEQ ID NO: 31856 - DNA, 129 bp, Homo sapiens
cgtcgatgaagaacgcagctagctgcgagaattaatgtgaattgcaggacacattgatcatcgacacttcgaacgcacttgcggccccgggttcctcccggggctacgcctgtctgagcgtcgcttgcg

SEQ ID NO: 31857 - DNA, 278 bp, Homo sapiens
cactgtggctcatgtctgtaatcccagcattttgggaggccgaggcgggtggatcacgaggtcgggagatcaagaccatcctgcctaacacggtgaaaccccgtctctacaaaaaacacaaaaaaattagctgggcatggtgacaggcgcctgtagtcccagctacttgggaggctgaggcaggagaatggtgtgaacccgggaggtggagcttgcggtgaaccaagatcgcgccacagcactccagcctgggtgacagtgagagactccgtaccaga

SEQ ID NO: 31858 - DNA, 470 bp, Homo sapiens
gattgccgataatttttagcttagggcctgttggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattgggaga

SEQ ID NO: 31859 - DNA, 444 bp, Homo sapiens
  misc_feature 5, 6, 30, 31: n = A,T,C or G
ggaannggtggaagatgattcccgaaggtnntgactgcagcttgtaccccccggagaaggatcattaacctcactagtgttttgagtctccaggaagaaattaatgagcagggacatggggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctct

SEQ ID NO: 31860 - DNA, 427 bp, Homo sapiens
  misc_feature 6, 31: n = A,T,C or G
aagacnatttggaagtcttgataaagctgtngattatggtctctgttctaatctcagttctgtataaaatattaacttgtctggaagatactagtaattaatctgtttaaaatatttcacctgggactgccattttattataaatacacaaacgaccttgcaattcattttccatttttatcggctaaataaagaaaaatattagccagcaatgagaagattgggaatttaaaatatcactttaagaaatattgtctgtactggcaaaacaagttttacgaagagatgtgaacactttttaaaagctttttcacaggatcatattaactgccaggaagttttgccaaacagattttaaggggaaaatcaggctatcctaactgtccaaatgttttctcacgtttcaagcaagcagctgctggaagtt

SEQ ID NO: 31861 - DNA, 323 bp, Homo sapiens
  misc_feature 6, 8: n = A,T,C or G
aaatcntngtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcgaccataatatggtcactaccctaatagactaaatgaaatcttgcaatttcaaattactctttctccatattagatttacccacagctatatttctgtttaagtactagggtgagggttttctgttactttgttttttaatgttgttccttttgaaaga

SEQ ID NO: 31862 - DNA, 402 bp, Homo sapiens
caggaaaaacaaggataataaataatgataagtcagaaaactaaaagctaagtaaaatactttcagtaatgaaacttctaatatttcaagcactgtttattaattaactttatcttcaacagcaaccttgtgttaggtaatagcattaccattctgtagaggagtaaactgagacgcagcaagattaagttatatgtgcaaggataaatagggagtaatggaagagccggagtttgaatctgaataatccaacttcaaagtgttaatcaccactccaggctgcctctcagccagttgaacctcataaaattcaagactataataagtggtcaaaaacctaagacgaaactctgcttacatggttatttaatatttgattgacaatgaaaaataattttaatg

SEQ ID NO: 31863 - DNA, 224 bp, Homo sapiens
  misc_feature 3: n = A,T,C or G
atntacataaatattatactagcatttaccttctcacttctaggaatactagtatatcgcccacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctact

SEQ ID NO: 31864 - DNA, 142 bp, Homo sapiens
tattaaacccatataacctcccccaaaattcagaataataacacacccgaccacgccgctaacaatcaatactaaacccccataaataggagaaggcttagaagaaaaccccacaaaccccattactaaacccacactcaac

SEQ ID NO: 31865 - DNA, 102 bp, Homo sapiens
aaccagagtgctggttgaaggaagctagaggtgtggctcagcagggtcccgagtcattgtttcttaaataggctctgatgggaatctggctttctgggcagc

SEQ ID NO: 31866 - DNA, 490 bp, Homo sapiens
gaagacccattataaaaatgataatcacctatttcctgtgaaaattacctaaagggcattcagcaaacagataaacattcatttgagaaaatctacaataactttataaaaacagcgagggactgctttgtttatgacttgcttcgttattaccaccccaccaccagcagctccatgatacagatgggtgtgagcaaccaagaagggaaagctcccttttccctacatccagtctggggctatggtttcaccctgggaggggcaggctgatagtgtctctcatcaccctcttgccaaatgttgcagaagccatatttcagcaaatgccccttcaatgactgtatcttctttttgcatgtagtctcttgaattcccctctctcaaccttctacagcagaagttccacatttctgaagaagcaagctgagaagaccaggggctacttccccttgtggtgctcactgctagtgcccactctgcggatcaagag

SEQ ID NO: 31867 - DNA, 111 bp, Homo sapiens
gagggcaaagagttggagttctatcttaggaaaatcaaggcccgcaaaggcaaataaatccttgttttgtcttcacccatgtaataaaggtgtttattgttttgttcccac

SEQ ID NO: 31868 - DNA, 192 bp, Homo sapiens
ctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacgagtgctttcccagctcttttc

SEQ ID NO: 31869 - DNA, 191 bp, Homo sapiens
gtgggaccaaagcagtatccttacaataatctgcacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgc

SEQ ID NO: 31870 - DNA, 209 bp, Homo sapiens
  misc_feature 48, 184: n = A,T,C or G
gaagcagaaagcaagtgaatacgagtcagaaagccaagtatcttcaanaccttctcatggagagtgtgaatttttcccccgccaatctctctagcactggttccaggtatctgaatgctttggttgacagtgcggtggcccttgaaataaaggatacctcgctagctagttttatccctgcagngaatgatttgacctctgatctcttt

SEQ ID NO: 31871 - DNA, 451 bp, Homo sapiens
  misc_feature 5: n = A,T,C or G
ggcgnccagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatga

SEQ ID NO: 31872 - DNA, 339 bp, Homo sapiens
  misc_feature 25, 30, 283: n = A,T,C or G
accctgtctgactacaacatccagnaaagngtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgncttagaggtgggatgcagatcttcgtgaagaccctgactggtaagaccatcactct

SEQ ID NO: 31873 - DNA, 397 bp, Homo sapiens
  misc_feature 24: n = A,T,C or G
cacccagtgtggagcagcccattntagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctga

SEQ ID NO: 31874 - DNA, 474 bp, Homo sapiens
  misc_feature 14, 38: n = A,T,C or G
atggccgggggggncgagtagtcgtccgacgtctggcnttgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatg

SEQ ID NO: 31875 - DNA, 323 bp, Homo sapiens
agcctgagcaacatagcgacaccttgaacatcagtgatcattaaagaaatgcaaatcaaaaccacaatgagataccatctcatgccagtcagaataaaagtcaagaaacaacagatgctggtgaggctgcggagaaataagaacactagaaatagggagaggtggctgttttttcacatgccaaattttcaacaaaagatacaaagaaggcaggcatgatagcacacacctataatcccagcttacttgggaagctgaggcaggaggattacttaaatccaacagttcaagtccaggctgggcaacatagcaaaatcccattt

SEQ ID NO: 31876 - DNA, 329 bp, Homo sapiens
taggcagtgcgtggtggctcgcgcctgtaaccccagcactttgggaggctgaggttggcggatcacttgaagtcagcagatcacttgaggttaggagtttgagatcagcctggctaacgtggtgaaacccagtctctactaaaaatacacaaattagctgggcatggtggtgcatgcctgtggtcccagccactcgggaggctgaggcaggacaattgcttgaatccaggaggcagaggttgcagtgagccaagattgcgccactgcactccagcctgggtaacagagtgagactccatctcaaaaaacaacaacaattaacaacaaca

SEQ ID NO: 31877 - DNA, 480 bp, Homo sapiens
ggagaggcaggtgtcagaggcagaggaaattgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgaatgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagc

SEQ ID NO: 31878 - DNA, 331 bp, Homo sapiens
  misc_feature 7, 30: n = A,T,C or G
aatatancaaggactaacccctataccttntgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagtccaactttaaatttgcccacagaaccctctaaatccccttgtaaatttaactgttagtccaaagaggaacagctctttggacactaggaaaaaaccttgtagagagaac

SEQ ID NO: 31879 - DNA, 361 bp, Homo sapiens
  misc_feature 32: n = A,T,C or G
ctgactacaacatccagaaagagtccaccttncacctggtgctccgtctcagaggtgggatgcagatcttcgtgaagaccctgactggtaagaccatcaccctcgaggtggaacccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccca

SEQ ID NO: 31880 - DNA, 476 bp, Homo sapiens
  misc_feature 39: n = A,T,C or G
atggccgggggggcacctgagtttttgtgactaacagtnagagttcatgttatttttatagtaataggctagttttacacaaggctgatgaattcattaacaacttaaatgaacaaattctatcaactataatcaatcattttatgattaaatgaatattaccaatatttgacatgttttgtaatatgtagattatattcctgagagattaaataagaactctgtaggccgggcatggtggctcatgcctgtaatcccagcactttgggaggccgaagtgggtgaatcacttgaggtcaggagttcaagaccagcctggctaacatggtgaaaccccatctctcctaaaatacaaaaattagccaagtgtggtggtgggtgcctataaccccagctactctggaggctgaggcaggagaattgctggaacccgggaggcggagcttgcagtgggccgagatcgcgccattgcactc

SEQ ID NO: 31881 - DNA, 305 bp, Homo sapiens
  misc_feature 29, 30, 298, 303, 305: n = A,T,C or G
gctcttcgttaagtcggccttccaacatnntgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtggggaactgggactntgtanan

SEQ ID NO: 31882 - DNA, 500 bp, Homo sapiens
  misc_feature 12, 14, 41: n = A,T,C or G
atggcccgggangnaggagagggaacatgctgagaaactgntgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttgggggtttcctttaccttttctataagttgtaccaaaacatccacttaagt

SEQ ID NO: 31883 - DNA, 469 bp, Homo sapiens
  misc_feature 5, 6, 30, 31, 32: n = A,T,C or G
ggagnngaatatgatgtggaagcacatgannnaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttg

SEQ ID NO: 31884 - DNA, 144 bp, Homo sapiens
actgtctgggctgggggggacactgtccaagggagtggcccctatgagtttatattttaaccactgcttcaaatctcgatttcactttttttatttatccagttatatctacatatctgtcatctaaataaatggctttcaaac

SEQ ID NO: 31885 - DNA, 486 bp, Homo sapiens
  misc_feature 4, 31: n = A,T,C or G
cttntactaggactgtaaacttttgtgatanaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttc

SEQ ID NO: 31886 - DNA, 135 bp, Homo sapiens
  misc_feature 25: n = A,T,C or G
aattcatggaaaaaaccttttgatnggataaagatgggaaagtcatgaagaagattgtgaccattcaggttcccctgtgagcgaaatgccaaattgaagaagaaaagaaaaagaaggaggtggagaaggaggaag

SEQ ID NO: 31887 - DNA, 232 bp, Homo sapiens
gggaggccaagatgggaggattgcttgtttccagcagttcaagaccagcctgggaaaccccatcttgacaaaaaacgcttaaaaattagctgggcatggtagggcatgcccatggtcccggctaattaggaagctgaggtaggaggatcacttgaactcaagaggtcaaggctgcagtgaggtgcaatcgcaccactgcactccagcctaggagacagagtgagaccatgtc

SEQ ID NO: 31888 - DNA, 444 bp, Homo sapiens
  misc_feature 5, 31, 32, 33, 57: n = A,T,C or G
catgngactttgtcacagcccaagatagttnnntgggatcgagacatgtaagcagcntcatggaggtttggagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttag

SEQ ID NO: 31889 - DNA, 406 bp, Homo sapiens
  misc_feature 4, 21: n = A,T,C or G
aatngactagcccatttcaanttctctagccttaagtggctgttgactatcatattgaacagcacagatctagtttatttcaaaagaagtaattgctacattaccaaaagtctccctgcagcaattgaaatacttaggagctatgtccacaagcattctaatttcctaaagagttttcttactgtagtttgcatcttccactgaatattaaagcatggtgaattttaaattgtaaacttttctggaagaactctttttatttgcttacattttaatgtatgtgcatatggctacacgtttttatttatttgagacggagttttgcttttgtcgcccagactggagtgcgatggcgcgatctcggctcactgcaacctctgcttcttgggttcaagagattctcctg

SEQ ID NO: 31890 - DNA, 218 bp, Homo sapiens
  misc_feature 6, 7, 18, 29, 30, 188: n = A,T,C or G
catatnnaacatcaagcntcgattgtgtnnttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggatttttttttttnggcccttctttcctcttaacgtaaatccac

SEQ ID NO: 31891 - DNA, 467 bp, Homo sapiens
  misc_feature 7, 8, 135: n = A,T,C or G
actgaannagaaggaagagaattgtcactgttttagtcaactgttagtcatattaggaaaaaaaatacatacaatacaatttctcaaataaagtctaaatatacattcaacgtttaaaaataatgagtatttcangatatttgaactcagtctgttctttattccataaaagatataggtaagccgtgcacggtggctcacaactataatcccagcactttggcactttgggaggctgaggtgggaggatcacatgagcccagcctgggcaacatagggagacccctatctttacaaaataaaatataaaatataaaacctagttgggcatggcagcatacacctgtggtcccaggtgctcaggagactgagacaggaggatcgcttgggcctgggaggtcgaggctgcagtgagccaggattatgccactgcattccagcctgggtgacagggcaagaccctgtct

SEQ ID NO: 31892 - DNA, 245 bp, Homo sapiens
  misc_feature 216, 225, 229: n = A,T,C or G
cttcgctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttggtcttttatcataganacctgcctntttnttctttggcgccctct

SEQ ID NO: 31893 - DNA, 350 bp, Homo sapiens
  misc_feature 5, 6, 30: n = A,T,C or G
gaacnngcccttttggatcttcatgccttntgttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgc

SEQ ID NO: 31894 - DNA, 172 bp, Homo sapiens
accctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcct

SEQ ID NO: 31895 - DNA, 288 bp, Homo sapiens
  misc_feature 33, 57: n = A,T,C or G
gaggctctgaggcagccagcgcaggggcttttnctgagggggcaggcggagcttgangaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagt

SEQ ID NO: 31896 - DNA, 334 bp, Homo sapiens
gcagagatgtggttcgagattctccccggactctccgtcatgggcgtgtgcttgttgattccaggactggctactgcgtacatccacaggttcactaacgggggcaaggaaaaaagggttgctcattttgggtatcactgaagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaat

SEQ ID NO: 31897 - DNA, 486 bp, Homo sapiens
  misc_feature 20, 33, 255, 263, 279: n = A,T,C or G
gtaggccgaaatacttttcnttgtttaacttgnaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaacttttttttttctatagacttttttcagataacatcttctgagtcataaccagcctggcagtatgatggcctanatgcaganaaaacagctccttggngaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattga

SEQ ID NO: 31898 - DNA, 424 bp, Homo sapiens
  misc_feature 5, 7, 30: n = A,T,C or G
ggaananatactttctcaaacttcatgttntttccctctaaagttagttagcacatattgtacattcagaagaaatgttcatttacagcaaggcataggtttttttcctctaaaagaaatttgaccaggtatggtggctcatgcttatattctcaacattttgggaggccaaggcaggaggatcactttgaagccaggagttctagactatcctgagcaacaaagtgagaccctgtctctataaaaaaataaaataaattagctggatgtggtaatgtgtgcctgtggtcccagttacccaggaggctggggcagtaggatcccctgagtctaggagtttggggctgcagtgagctatgatcatgccactgtacttcacgctgggcaacagagtgagacctctgtctctaaacaaaaaggaagg

SEQ ID NO: 31899 - DNA, 110 bp, Homo sapiens
  misc_feature 30: n = A,T,C or G
tcactatgtacacgatcccatcacgttaanaatgtctgaggggtctggcggtgctggcaagatggctgcactttgaaaagatgacgtttcccaagaagatgacatttcca

SEQ ID NO: 31900 - DNA, 298 bp, Homo sapiens
  misc_feature 296: n = A,T,C or G
cctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacngc

SEQ ID NO: 31901 - DNA, 466 bp, Homo sapiens
  misc_feature 31: n = A,T,C or G
ggggggaaatcctctctgtaacaaaactttncacccagttatgataaaaacactcaagaaagtagcaatggagagatacaatctcaacatggtaaaatgtatatgctttagtttcacttatggactagggaagctctagaggcatttccactaagatcacaaatgaggcaaggatcatcactatcttcactactgttcagtaatgtactacagatattagccaatgtagttaggcaagagaactcaattaaaggcataaggatgagtgtaggagaaataaaactgtctatttacggatgatataatagtatgcctggaaaaccccggagaatcaatgacaaattagcagtggaagaattcatttaatgcggtagtgagacataaaattaacatacaaaaagcagtagtctttctatacacaaacaataaacagttaaaagacatataatgggggaagagaatccca

SEQ ID NO: 31902 - DNA, 346 bp, Homo sapiens
atcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattgtttattgaagtcaaactgtgatggctggctgcttggaacatcatcatctattaaaaagcaccaagaccc

SEQ ID NO: 31903 - DNA, 368 bp, Homo sapiens
tcatctccaaaaccccactttctccttcctttgagcctccgtaccagctggggcgtccggcaagatgtgagttgtcactctgctgcggcacagacctgaattaacaactctagctagggctgacttcaaaaagcactttcgttttttaataaccaacattagctcagcaggcttcatttgggaaaagaaaccttgtcggattaccccgacattctccacctcctgggaggccagccattcccaaatgccccaaggatgaagaacggagacggtaagatgattaattgcactgcaggttttttgtttctgtatttttttccctcctttttttgggtttacttacacattaatgaggtatttaggaaaga

SEQ ID NO: 31904 - DNA, 167 bp, Homo sapiens
  misc_feature 167: n = A,T,C or G
aaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtn

SEQ ID NO: 31905 - DNA, 468 bp, Homo sapiens
  misc_feature 6: n = A,T,C or G
gaggcncaaagactgggacttctcgatgatttttaatgtgcgcagcatgtacctgatgatcaaggcattccttcctaaaatgcttgctcagaaatctggcaatattatcaacatgtcttctgtggcttccagcgtcaaaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttagga

SEQ ID NO: 31906 - DNA, 369 bp, Homo sapiens
cggtgtagtggaccagaggcccctctcctgggcttctcagtgtctcgccggcggggttcggcctgagctggattgacatagcccttggcggatttaaacaacctaaacattaagcagtacagctgcctcaaacctttggggttgcaagacaacagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctccttacggttactactgatagaaatgttggcagcttttagtaaaagcatttactctgtta

SEQ ID NO: 31907 - DNA, 439 bp, Homo sapiens
aggaaaatttcccagaacaagcagacataaattcccagattgagagaatccatcagaagacatcacatataatggaaaaaaccataccgtatcaggcatattgactgaactttcagaacaacaggtgaaatagaagataatattagctatcagaaagggaagaaaaagtcacattccccaaaccagaaatcaaaaggacttcaaactcttcaacagtagtgggcaaagtgccaaaatattggagcaatacctttaaaattcacaggcaacattattttcaatctagaattctatactcaaccaaactacaaattaagtgtctaggtcgcaagacattttcagatgtgcaccgcttcaaaatatttacctcctgtgagtcttctgtaattccttctgtgagtctaatgtactccactgaaatggagtacattaagaatat

SEQ ID NO: 31908 - DNA, 497 bp, Homo sapiens
aaaatttcccagaacaagcagacataaattcccagattgagagaatccatcagaagacatcacatataatggaaaaaaccataccgtatcaggcatattgactgaactttcagaacaacaggtgaaatagaagataatattagctatcagaaagggaagaaaaagtcacattccccaaaccagaaatcaaaaggacttcaaactcttcaacagtagtgggcaaagtgccaaaatattggagcaatacctttaaaattcacaggcaacattattttcaatctagaattctatactcaaccaaactacaaattaagtgtctaggtcgcaagacattttcagatgtgcaccgcttcaaaatatttacctcctgtgagtcttctgtaattccttctgtgagtctaatgtactccactgaaatggagtacattaagaaatatgaaagatgtgagatcctagaagcagggaatactactcaaaggggacgtgaaaggagtatc

SEQ ID NO: 31909 - DNA, 378 bp, Homo sapiens
  misc_feature 22: n = A,T,C or G
ctgtgaagtaagatgctgtccntccaactcttaagtgttttctgattaaatatctagtttggcaacagtagaaattaaatttatgaaattcagcaggagggtaggttttaattgagtaacaattataaaactttattcttatacataataattaaatgcagttttgtatatggacattaattgattcattcttttatgatagatgttactactatctacccatacagaaagcaccaaaattagcctcctagattttaatttattaataatagaagaatgtgcgtttctcatatgtaagaagcatatttttccttcatactttggtatctttagagtatcaattagtggtgatagtgccagtaaaacatatttctgttg

SEQ ID NO: 31910 - DNA, 119 bp, Homo sapiens
  misc_feature 23: n = A,T,C or G
cgctctgctgggaattagaagtncatttctagttaccaactgaagaattaattgaggctttatgttttaaatgtgctcaactcagtgttcaaagatgaagtgtagggtttttccccttt

SEQ ID NO: 31911 - DNA, 394 bp, Homo sapiens
  misc_feature 5, 31, 33, 57: n = A,T,C or G
aatancaagataagcataagttataaatgtntntgcttttgttcttttccatttttngctgaaatccttaaaaagatgctatctcattttataccctttttttaaaaaaaaagggaaattcaagttaattgaatcttgcatattacatatacaaatatcttcctgtctagtaatttctttattcacagagcatatagcaataatttgacatcatactttgatgtctgaaaacctatgcaggatgacatggagtaagaggggtataattgtagaaccaaggcagggaaaaaagtgatgagcacacccagagtttgtcttcatatgagccataggttaaaatcaagcctacattttagatgaatgattattgtatgtatgctgatggaaaataaga

SEQ ID NO: 31912 - DNA, 486 bp, Homo sapiens
  misc_feature 36: n = A,T,C or G
ggtaggagcctctctccctactgctgctttttaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttcttt

SEQ ID NO: 31913 - DNA, 475 bp, Homo sapiens
  misc_feature 5, 6, 31: n = A,T,C or G
atatnncgatattttcctaataatttttatngttggagtttaaaatgcttttagagagatgaactcttttaaaacaaggtatctccaggtcagctttcatatacactttaggctcagcagtaggtgcttggtggtgctgcctgaatgatggacttttggtctgtgtattgctattattgattacttcagatggtcgataggtgtttgtgtttgacatagacagaataaatgggcactgctatatgatggatgagtatcacagcgtctggaagggctctgccttcacataactcttttaggaagggctaacaccagtgtgttctgatattgcttttgttctctgagtaggtgaatctgtgcacagagataacaagcccttttgaattacagggccactagggtacaaatgctagccagccttccagattattttcataactaaaaatgggctgcaaaccagcttcatccaatttcg

SEQ ID NO: 31914 - DNA, 371 bp, Homo sapiens
  misc_feature 32: n = A,T,C or G
ggggctgacctgtgaaagtctgggaaggtttncgagagaagcggagtgttttcagctccggaagtggcagttgtaaacttcacctcccgggggctcttccccttctgtacccctttgctgtttgtccccctcctcccgggtcctggagtccgtcgtgttccaacagtttttgctcttattcccgtgggctgcctgggcctcctttcacccgtgagacttggagcggcccctggggtcttgggtgtgcagcacggatcacgcgagacccctgagacctcaaatcatctaacgtgaagccacagacatcttgggcaattttaatcatcaagaaagaaatatgtcattaagaaatagcagggtattttgaaaga

SEQ ID NO: 31915 - DNA, 500 bp, Homo sapiens
  misc_feature 25: n = A,T,C or G
tctggatgagccaggggacacagangagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgactccgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataactgaaatcaaagatggagactttaagaacctgaagaaccttcacgcattgattcttgtcaacaataaaattagcaaagttagtcctggagcatttacacctttggggaagttggaacg

SEQ ID NO: 31916 - DNA, 110 bp, Homo sapiens
  misc_feature 6, 57, 104: n = A,T,C or G
attgcnctaaatataagtattcaatatactttatgtatttgtacagataggtgtatnaatgtattatgtacatgtatatattcccaactctgttcattgagcgngtctga

SEQ ID NO: 31917 - DNA, 266 bp, Homo sapiens
  misc_feature 5: n = A,T,C or G
aagantggaatgatctcacttgaaatttgattgaagtctcctgtaaaactatgtggacctggtggttttgtatttgggataaggtggggaaaaggtggaaattaactacaagtcccatctctatattgtatagccagtattcacttagtctgttctttttagtaggttgaatttttctaggaattagagcatttatttttttcatgtctgttatttctgtcttctctctgtcttgtcacaaggtttctatgttttattagtcttga

SEQ ID NO: 31918 - DNA, 280 bp, Homo sapiens
  misc_feature 3, 4, 31, 33, 56: n = A,T,C or G
agnnctaacattagtaacttcttgtatgttntnttatggcagatctctttacgttnctttctcgcatctatctgctagtccaggaatttgttactaaatagattttcttggatatttggttgcctcaaagtgcttacatttgttaacagattgtaaaccacatttatttacattgatgaatgggctgttgaataatcattgtaaagcactttgtatatataaggtgctatataagtgtgaaatatcattcatttataaatgaaatgccttctaactttca

SEQ ID NO: 31919 - DNA, 275 bp, Homo sapiens
  misc_feature 28: n = A,T,C or G
agcagcggctctgcctgtaatcctagcnttttgggaagcctaggcaggcagattgcttgaggccaggaatctgtgactagcctaggcaatatggctaaaccctgtctctacaaaaaaacacaaaaattagctgggtgtggtggcatgcacctcaagtcccagctacttgggagactgagctgggaatatcgctggagcctgaggagtcgaggctacagtgagctgtgattgtgccactgcactccagcctgggtgacagagcaagaccctgcctc

SEQ ID NO: 31920 - DNA, 228 bp, Homo sapiens
  misc_feature 24: n = A,T,C or G
gatttactgtaatagtttgtttanaccatctgcttcatctcttctagtccttatacctctttttcctgttttactttattagacaagttttcagtagtatgttgaaaaatgtccttagtgggcattctgacctgtctatcctaagtgatatcctaagcttctgaagtttttccattaagtttgatttttgttattggcttttggtatatagactttttctttttcttt

SEQ ID NO: 31921 - DNA, 152 bp, Homo sapiens
acctgattaaaagaaaaccaatatttaaaggcatttaatagatatcaagtataactttgaggagaagaatcaatctgtattaccaaaaaaaaagtgttttcattttctgtaagatacaatgaactggtacattaaaagtcaattttgtgtcg

SEQ ID NO: 31922 - DNA, 104 bp, Homo sapiens
  misc_feature 24: n = A,T,C or G
gtcatataagattcatatttactncttatacatttgataaagtaaggcatggttgtggttaatctggtttatttttgttccacaagttaaataaatcataaagc

SEQ ID NO: 31923 - DNA, 444 bp, Homo sapiens
  misc_feature 5, 7, 31: n = A,T,C or G
gtaanantggggaagaacaatcagcagattntgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtctgatgtcacgacatccgaactggagggacaaggatcttaaacccaaagtacgagaaatgtttctgttgaatgcaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattaggggaagagaagaatgttgcttaaga

SEQ ID NO: 31924 - DNA, 384 bp, Homo sapiens
tcctaaatgcattacaaaactgcttctcttttgctggacatttagggtgtttccaatgttttgctattataaacaacactacaaagaacatccttgacaataaatcattgcgcacatcctctattatttccttaggataaatttctagaaatggaatttttaagccagggaatctgcacatatttaaagacgtttgattgtattgttgtgttgtattgttgtattattgtgttgttcatcagaaaggctgtagtaatttatactcatattggcagaactccggaactccagaacagccttttaccaactcaaagtgagacttgtagagataagtacaatacaggttgaggactttgtctctggggtcttgcacctgattccctt

SEQ ID NO: 31925 - DNA, 446 bp, Homo sapiens
  misc_feature 34, 59: n = A,T,C or G
gggctcctgttctgtttcattggtctatattttntgttttggtactagtagaatcaatntcgtgaaaatggccatactgcccaaggtaatttatagattcaatgccatccccatcaagctaccaatgactttctttgcagaactggaaaaaactactttaaagtttgtgtggaaccaaaaaagagcccgcattgccaagacaacgctaagcaaaaagaacaaagcaggaggcatcatgctacctgacttcaaactatactacaaggctacgggactgctttcagctccttgaggccagtggtattccttgtcacatgtctacctctacctttaagccagaatactgtgtcaaatccttcttatgctttgaatctgtgaattcctctgtctctgacctctacacccaaatttaaagagtttatgtaattgtctccctatttttagtg

SEQ ID NO: 31926 - DNA, 445 bp, Homo sapiens
  misc_feature 24: n = A,T,C or G
ataccaaaaacaattggaacaaangcaaaattgacaaatgggatctaattaaactaaacagcttctgcacagctgaagaaactgtcaatagagttaatagacaatctacagaacgggagaaaatatttacaaactatgcatctgacaaaggtctaatatccagcatctataaggaacttaagcaaatttaagagaaaaaacaaacagccccattaaaaagtgggcaaagaacatgaacagacacttttcaaaagaagacatacatgtggccaacaagcatgtgaaaaaaagctcaacatcactgatcaatagaaaaaagcatatcaaaaccacaatgaaataccacctcacaccattcagaatggctgttattaaaaagtgaaaaggtaacagatgctggcaaggttgcagagaaaggacaatgcttatacactgctggtaggga

SEQ ID NO: 31927 - DNA, 107 bp, Homo sapiens
atgcatcagttctccgatgctgaggaatcagatggtgaggatggagatgataatgatgatgatgatgaagatgaagatgactttgacgaccagggagatttaacacc

SEQ ID NO: 31928 - DNA, 440 bp, Homo sapiens
  misc_feature 4: n = A,T,C or G
cagnaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaagtaaggcatagagaacacttgctcttataccctagtggtggcggtcaagctaacaagtgtgaaaatgcctttggcatttttaaaaaagtgcaatcaataaagcagagttctgtcaagaatgagtaagttaacagccagagacagacactgtgcaggcattgcaaatagatggaattacagcaaaatgtgctcaatgtatttgcctgcttacaacactgggaga

SEQ ID NO: 31929 - DNA, 114 bp, Homo sapiens
  misc_feature 24: n = A,T,C or G
cagccctcgggaggctgaggcagnagaatggcgtgaacccgggaggcggagcttgcagtgagccaagattgcgccactgcactccagcctgggtgacagagcgagactccgtcc

SEQ ID NO: 31930 - DNA, 344 bp, Homo sapiens
  misc_feature 8, 9, 23, 30, 39, 42, 61, 74, 77, 78, 85, 86, 115, 145: n = A,T,C or G
gaaccccnnagctgaaacacttntgctcanttttggaanatntccgactgctgaggagctncttcttgccctgnccnnaataggnnaatagttgcacaagaaagaaacgcctggngcagagccccaattcctacttcatggatgngaaatgcccaggatgctataaaatcaccacggtctttagccatgcacaaacggtagttttgtgtgttggctgctccactgtcctctgccagcctacaggaggaaaagcaaggcttacagaaggatgttccttcaggaggacgcagcactaaaagcactctgagtcaagatgagtgggaaaccatctcaataaacacatt

SEQ ID NO: 31931 - DNA, 189 bp, Homo sapiens
  misc_feature 25, 118, 149, 158, 186, 187: n = A,T,C or G
ctaccagacaaccttagccaaaccntttacccaaataaagtataggcgatagaaattgaaacctggcgcaatagatatagtaccgcaagggaaagatgaaaaattataaccagcctanttttggcaggggctacccccttaacccttcnggtttatgnaattacctagaaaaacttgggggggggnngc

SEQ ID NO: 31932 - DNA, 224 bp, Homo sapiens
  misc_feature 22, 23: n = A,T,C or G
atgttttccagtaaactagaannacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaatat

SEQ ID NO: 31933 - DNA, 447 bp, Homo sapiens
gttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttat

SEQ ID NO: 31934 - DNA, 182 bp, Homo sapiens
  misc_feature 25: n = A,T,C or G
tagattttaatttgactcacagtcngaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaag

SEQ ID NO: 31935 - DNA, 314 bp, Homo sapiens
  misc_feature 3: n = A,T,C or G
tcngggttagggatcttactgaactgtgaattttatttctgtttgggtccaattatctacagaaggagcatccatacatacaaatattattttgccgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatat

SEQ ID NO: 31936 - DNA, 296 bp, Homo sapiens
ctcaaagggaacttggaaatgacattggcatccagattatccactgcagtaaatattgggaagatggattcacccattgaaaagtggaacctaataattggcaacttggctttaaagcaggttcaggcaacagtagtgggttttctagcagctgtggcagcaattatattgggctggattccagaaggaaaatattaccttgatcattccatacttctgtgctctagcagtgtggcaactgccttcattgcatctcttctgcagggaataataatggttggggttatcgttggttc

SEQ ID NO: 31937 - DNA, 133 bp, Homo sapiens
  misc_feature 56: n = A,T,C or G
gaaacaaatggtgagaatttgaattggtccctcctattatagtattgaaattaagnctacttaatttatcaagtcatgttcatgccctgattttatatacttgtatctatcaataaacattgtgatactcgac

SEQ ID NO: 31938 - DNA, 408 bp, Homo sapiens
tcctcggattcccgacgctgtggttgttgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtgggtcttgtactaacttatgatagaatgtatcaga

SEQ ID NO: 31939 - DNA, 481 bp, Homo sapiens
agctaatgtttgtatttttagtagagacgggatcgccatgttggccaggctggtctcaaactcctgacctcaggtgatctacccgcctcagcctcccaaagtgctgggattacaagtgtgagccactgcaccttgcctgtgtgtatgtttttgttgagggtgatcttgtaggatttaaagaagggagtaggaggaaagtaatgatgcactcaccagccagttttctagcccatttttattacctactgtgtgctcagcactgggatgagaggaacacatgccgggccaccctgtatcctactggtactgtgatttccaacaccatcccctgttctttgactgatgaaatcggcatatgataagggaccatggtcattggaaccatgattggaaaactataaacttgattctattgtctgtatcagaactggccttagaccttaaaccttaaaaccttcagtaaactctgctagaaaataga

SEQ ID NO: 31940 - DNA, 210 bp, Homo sapiens
  misc_feature 23, 207, 209, 210: n = A,T,C or G
tacagggcctttgttgatgttgngaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccncnn

SEQ ID NO: 31941 - DNA, 233 bp, Homo sapiens
ctgtattttctcacttataagggagagctaaattctgggtacatgtggacataaagatgagaacaatagacactggggactactagaggggaaaaggatgtgggggcaagagctgaaaaactccctgttggatactatgcttactacctggatgatgggttcaagtcataccccaacctcagcactgggcaatatagctttgtaacaaacctacacatatactctctgattct

SEQ ID NO: 31942 - DNA, 410 bp, Homo sapiens
ccttatggccgggaatacgtgggataacgaaccttatcagagagaatccacatgaggtacctactgtgcagctgtataaagtctgcatcagttggaactatcagttgcagaatgaaatttaatgggtgagagtcatttttaaaagagataaagctgaggatctttcagaattcttgaaagacaacaactgtctgattaaggaggccccacaattcccaagcaggaaatctaaaaaataatagccttaatgctgatatttggcaagaagaaaggctcagaagtaatgaactagaaaaagaataatagagtaaacccaaagtaaacagggaaggaaataataataaagataataagttaattaaatagaaggcaagacacggttgagatcaggaaagatgatggttgtttgt

SEQ ID NO: 31943 - DNA, 330 bp, Homo sapiens
  misc_feature 277: n = A,T,C or G
ggagaacggcccttgctgccaccaacatggagactttgtaccgtgtccctttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgatgatgaacatgggcatcagaggccagtagctttcttggcctacagagtaaatggacaatatatnatggaaggacttgcatccagcttcctatttacaatgggaggtttaggtttcat

SEQ ID NO: 31944 - DNA, 323 bp, Homo sapiens
atgttaggatagttcaacagttttaagtatgctctgggctgggtgcagtggctcatgcctataatcccagcactttgggaggccaaggcaggtggatcacttaaaccccagagttcaacaccagcctgggcaatgtggtgaaaccctgtctctacaaaaaatacaaaaattagccaggtgtagtggcacacacctgtgatcccagctactcaggaggctgaggtgggaagatcacttgagcccaggaggtcaaggttgccgtgagcccaaatagcactactgcactactccactccagcctgggcgacagagtaggaccctgt

SEQ ID NO: 31945 - DNA, 497 bp, Homo sapiens
  misc_feature 2, 48: n = A,T,C or G
tncccgggaattcggccattatggcccgggccaagtgattattatttnagttggctcacgtgggttactgatgaacgagtatgtttgcagtggctaaaaagagtccagaatgcttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaggcaagaagcgtgttacttgccatct

SEQ ID NO: 31946 - DNA, 381 bp, Homo sapiens
gacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgtcactaaactgggttaaatgtacactgttgagttttctgtacataaaaataattgaaataatacaaattttcct

SEQ ID NO: 31947 - DNA, 419 bp, Homo sapiens
  misc_feature 12, 14, 41, 95: n = A,T,C or G
atggcccgggananccctttgtgtttcctgccttatttttntttaaaggatggaatggcccgtatgccatgttcatgccaaaaccacccttaacnaagatttatgaggtaatgcagcccttctttttaaaatatgatttctaaaagacccaaaaatagctttttgctattccattatttgtacctagttaagaaataatagctaattttcaaattacatctattctaatgatgtactatttttttgtgccgtagaggataatcatttaattacatgttaatgaagtatatacatattgtattttaaaaataagagaaatgaaagataagaaaaatttaagacatatcccctaaagagcttatataactagctgtatttaggaatagatactggggaaagttaaatactggtattagagc

SEQ ID NO: 31948 - DNA, 494 bp, Homo sapiens
  misc_feature 2, 10, 127, 214, 270, 324, 349, 360, 479, 485: n = A,T,C or G
anttcggccnttatggcccgggatctttgtcttttttttttgagaggagtttatctctttttgcccaggatggagtgcaatggcatgatcttggctcactgcaaccctctgcctcctgggttcaagngattctcctgccttagccctcccaaatagctggtagctggggttacaggcacacgtcaccacgcccggctaattttgtatttttagnaaagatgggggtttcaccgtgttggctgggctggtcttgaactcctgacctcaggngatccacctgccccagtctcccatactgccgggattacaggcgtgagccaccgngcctggcctatccttgtctattttngtttaataatnaaaacatgtttgctttgtacttgtctttgaattttcacccctggatattgaattttttttctttcaatgtagcattgaaaactcatctctacaaagatttaaaaaaattagctaggtgngggggngtgtgcctc

SEQ ID NO: 31949 - DNA, 468 bp, Homo sapiens
  misc_feature 21: n = A,T,C or G
gtagccctggctctgagaaanaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccctgtgaacatcccctattgagacccactgctttagcga

SEQ ID NO: 31950 - DNA, 465 bp, Homo sapiens
attcctgaataagggacatgcaagggccagaagtagcttgactctcgcctaaatatctgtgcctttgcctgtcctttctcccactctactgaaaccccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccct

SEQ ID NO: 31951 - DNA, 244 bp, Homo sapiens
ggagtatttcccttaatgtaaaacttcacttaacagagtagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaagcc

SEQ ID NO: 31952 - DNA, 255 bp, Homo sapiens
  misc_feature 3, 18: n = A,T,C or G
ccnttatggccgggaganccgatgggacttaaaccacaaacacttagttaacagctaagcacccctaatcaactggcttcaatctacttctcccgccgccggaaaaaaaggcgggagaagccccggcaggtttgaagctgcttcttcgaatttgcaattcaatatgaaaatcacctcggagctggtaaaaagaggcctaacccctgtctttagatttacagtccaatgcttcactcagccattttacctcacccc

SEQ ID NO: 31953 - DNA, 205 bp, Homo sapiens
aacacaaagtgtagatgaatcatcatttattcttagaaatctaaagagccaagcagtttagaaatagagtagcaacacttttgacttcatattaactcatacaaaaggttgatgttagtatacagttgaatacattatagagatttatatcaaaaaacagtgttcacttgacacgtgagtcaaactgttaactgcattttttttt

SEQ ID NO: 31954 - DNA, 422 bp, Homo sapiens
gtctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 31955 - DNA, 227 bp, Homo sapiens
  misc_feature 9, 43, 44, 45: n = A,T,C or G
atttttgtnccccgggaattccggccattatggcccgggagannnagttttttccaccatacatctgtgccttttctctttaggtgacctgtttaagaaaatttgtgtgcatagttacctcagtttttatgaactgttgtatcccgttaatgcatattgctctgtgactccagtatatcttacctgtactgaccaaacctaaataaagatttttattgtaactcctt

SEQ ID NO: 31956 - DNA, 461 bp, Homo sapiens
  misc_feature 8, 9, 43, 45, 80, 105, 460: n = A,T,C or G
tccggccnnttattggcccgggggaggaagagtgagggttccnancttttctgcttatctgggaggtgttgggccgcggncagtcgagatgtcagagaaaaagcngcccggtagaccttaggtctgttagaggaagaccgacgagtttgaagagttccctgcccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgttttttgtaacacaaaaaataaatgttttgatnt

SEQ ID NO: 31957 - DNA, 300 bp, Homo sapiens
  misc_feature 32: n = A,T,C or G
gatgatgaagactctgcaattggtccccgganccccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgc

SEQ ID NO: 31958 - DNA, 176 bp, Homo sapiens
  misc_feature 2, 5, 34, 41, 55, 71, 72, 115, 127, 134, 165: n = A,T,C or G
tnacntaaacccacaaacacttgaggctaacagnctacagncaccctaatcaacnggcttcaatctacttnncccgccgccggaaaaaaaaggcgggagaagccccggcaggttngaagctgcttcntcgaatntgcaattcaatatgaaaatcacctcggagcnggtaaaaagag

SEQ ID NO: 31959 - DNA, 336 bp, Homo sapiens
  misc_feature 10, 28, 221, 263, 269, 320, 326: n = A,T,C or G
ggaaatcagnattcagaacaggcactgntagatgctttactaacgatgaattgtttaatgctgaagacctatgagatcataggattcaagaaccatttagttttagtgtccaagttaattcaaattgccttgtaggacctcatcattactactatgtaatacttgctcagtatgacccagtgtcatcaaaaaatgttaaattttattaagtgattgtttangaagactgaggtgagagtatcctccagtgcagcatggacgcnccaggnagtttgaggctgcagtgagctatgatcatgccactgaactcttgcctgggngacaanatgagaccct

SEQ ID NO: 31960 - DNA, 445 bp, Homo sapiens
  misc_feature 2, 18, 37, 351: n = A,T,C or G
tncccgggaattcggccnttatggcccgggcacagangaaactctgcattctcgcttcctggagggtgtccgcaatgttgcagtgtctgtctgcagattggctaccccaactgttgcatcagtacccccattctatcatcaacgggtacaaacgagtcctggccttgcctgtggagacggattacacccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggnattttggtctctttgactaatcaccaaaaagcaaccaacttagccagttttatttgcaaaacaaggaaataaaggcttactttctttaaaaaac

SEQ ID NO: 31961 - DNA, 379 bp, Homo sapiens
agagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgtcattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctaca

SEQ ID NO: 31962 - DNA, 289 bp, Homo sapiens
ggctgttaaaatgtcagcagccaaggaagaagcagcgacctggcgtctgctcgggccagggtcgataaagacaggagtggagtgatatcagacaccgagcttcagcaagctctctccaacggcacgtggactccctttaatccagtgactgtcaggtcgatcatatactacactgaaggctggttacgctcttatgtgcaatagaacctcaaacacatcgtaacacacctttggagaatccttacaagaacaccaagttaacagttatctctgaccacactacctcagc

SEQ ID NO: 31963 - DNA, 500 bp, Homo sapiens
  misc_feature 2, 9, 81: n = A,T,C or G
tncccgggnattcggccattatggcccgggctggcgcaatagatatagtacccgcaagggaaagatgaaaaattataaccnagcataatatagcaaggactaaccccctatacccttctgcataatgaattaactagaaataacctttgcaaggagagcccaaagctaagaccccccgaaaccagacgagctaccctaagaacagctaaaagagcacaccccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacc

SEQ ID NO: 31964 - DNA, 408 bp, Homo sapiens
  misc_feature 1, 11: n = A,T,C or G
naattcggccnttatggcccgggatggaacctaatgtacccttgattattatgaaatagagcatcttgaaattcagttttactctaaatgtacttttaatacttgcagattctaagattacattgtaaaattccaggttttcataatgttaaaataggaaagtagaatataaagtatcaacaagtgtagttatacattttgttttggatatttaatccttacttgggaaaaaatcagcatctaggtaaattattattttaataagaactcttaaattgccaacctctgagaggtgaaaagctatgtaaatagaaggaatggccagttcaaaagaatagtagatgtgatagtgccgtgaatgtattctactggaaatgaatgtaataatacattaaaatttttaaaatc

SEQ ID NO: 31965 - DNA, 334 bp, Homo sapiens
  misc_feature 9, 19, 40: n = A,T,C or G
tccccgggnaattcggccnttatggcccgggcctgcaaanatatcgcaccaaataaaagtgttttacttttgaaaaaaattgtcatataccccactgtttttatatttgttgatgtataatttttctacatgaaataaactactattgaataaagtacaataaaatatattcttccaactttgaattagcagtgttaccttatttttgtatgttagtcttttaaaatgagggcagagtaaagttgttttattttctcccactttaaattgtaaagagcaacatatatttatcgtggttaacaagcatattgtaaatggtgtgtggaggaaatgc

SEQ ID NO: 31966 - DNA, 308 bp, Homo sapiens
gacaaacaaacaaacaaacaaaatttcaattctgacaaggtcttcccatactgtctgaatgactgaagtgactacatgatgaacgaaaggcactattttcaccccttcccattctgttctggtaaatagttgcatcttaaaacaaaacagtatacttaaattggaattaccttctcttttctatttaaagtaaacatctttctcaagtaatatttatacaggaacagtttttgtttatggtgacagttaaaatcaagttgctcaaagagtagcctaacagattagggacaagcaaatgtaaataaata

SEQ ID NO: 31967 - DNA, 331 bp, Homo sapiens
gaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacaga

SEQ ID NO: 31968 - DNA, 173 bp, Homo sapiens
  misc_feature 2, 19, 30: n = A,T,C or G
gnttttttgtcccccgggnaattccggccnttatggcccgggatagaaaatcttaaggaatccctaagaaaaataaaggaggacaggtagtgataaatgcaaaaacagaaagtaatgaaatagaaaacaagaaaatagaattaaatctaaagccctttttaaataaaattaac

SEQ ID NO: 31969 - DNA, 260 bp, Homo sapiens
  misc_feature 24: n = A,T,C or G
cgtaccacaaatataaggcaaagnagaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccacctg

SEQ ID NO: 31970 - DNA, 168 bp, Homo sapiens
  misc_feature 63: n = A,T,C or G
gctttttcgcaacgggtttgccgccagaacacaggtgtcgtgaaaactaccccctaaaagccnaaatgggaaaggaaaagactcatatcaacattgtcgtcattggacacgtagattcgggcaagtccaccactactggccatctgatctataaatgcggtggcatcg

SEQ ID NO: 31971 - DNA, 129 bp, Homo sapiens
gaaggagatagagacacaaaaaacccttcaaaaaatcaatgaatccaggaggtggtttttttgaaaagatcaacaaaattgataggcctctagcaagactaataaagaagagagaagaatcaaatagat

SEQ ID NO: 31972 - DNA, 456 bp, Homo sapiens
  misc_feature 1, 11: n = A,T,C or G
naattcggccnttatggcccggggcagcaaaatgatatatactgtaatctggtttttgaagtatctactattctggaatattgttaaacaactttttgcttttgaaaaaaaaaggtgccttgattcagttgcgtgacttagaacattcatcctattttattgtgatttttaatgtcttctgaccccaaactgtgtttttggttgcagtctggcggctgcaggcatagcgtcggttttgttccaataacagagaccaaagagttaatcagatatggttcagctgctacaattgtatgattcaaaggcaatttaatcaccccaaatttccatggcccccacagtcaagacctgccattcgttttctcttgcaggttggagtaaatttgcactttgaatcatgtgggtcatttgggggccttgttcttttctattttgctttattaataaaggaacttg

SEQ ID NO: 31973 - DNA, 273 bp, Homo sapiens
  misc_feature 8, 9, 27, 43, 53: n = A,T,C or G
tccggccnnttaatgggcccggggtcnatgtaaattgaaaganctgagaaaangttgggtccagtcgtgccttgattggaaattgttgtttcctaaatctatatgagaaattgacaataagtatttttattataacctcagcccatacatatatacctatgtatgcagtgcatctgcatagaacagttccttatccttggccttctgttttattgtttttttctttgctgttttccctttgcttctaatattacagttttgtattttgtaaac

SEQ ID NO: 31974 - DNA, 325 bp, Homo sapiens
  misc_feature 2, 41, 47: n = A,T,C or G
gntttttttccccgggaattcggcattatggcccgggaganaggccnggtgcagtggctcgcgcgtgtattcccagcactttggaaggccaaaacggatggatcacctgaggtcgggagttcgagaccggcctggctgacgtggtggggcccccgtctctactaagaatacagaattggccgggtgcagcggttcatgcctgtggtcccggctgctcgggaggctgagacgggagagttgtttgaacccgggaggtggaggctgcagtgggctgagatgacgccactgcactccatcctggacaagacagagcgggactctgtct

SEQ ID NO: 31975 - DNA, 464 bp, Homo sapiens
  misc_feature 10: n = A,T,C or G
gttccccagnaacttttaccaactattttttatgtgctggggatacaacagatatatcaacttgatttctgcctcctaggactcacaaatagttaactgatataggttaataaatgagataactgaaaaatgtgcaaagtgctgtcaaaatacagaggatctcttaactctgcccaaactaggggacgattgacataattaggttttacagaggaagtaacatttgaagtggccttgaagggtacggagggttttaccaggaaggaaaggcaggaacaggcactgcaggtagacagtagcattagtaagggcagagttagagggatgcagagtctatttcaaaaggtagtctattgtggaaaatgtagcagattgaagatgtgttttcttatactacaaaccaaaaaaagacagtttataaaaactataaatgcggctgggtgccggtggcacacgcctgtggt

SEQ ID NO: 31976 - DNA, 352 bp, Homo sapiens
  misc_feature 22: n = A,T,C or G
ccttatggccgggaggatgaanaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattgggagaagtttagaagatagaaaaatataaagcc

SEQ ID NO: 31977 - DNA, 205 bp, Homo sapiens
  misc_feature 11: n = A,T,C or G
aactttttatnctcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggca

SEQ ID NO: 31978 - DNA, 459 bp, Homo sapiens
gggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgtt

SEQ ID NO: 31979 - DNA, 189 bp, Homo sapiens
gcggcgacgacccattcgaacgtctgccctatcaactttcgatggtagtcgccgtgcctaccatggtgaccacgggtgacggggaatcagggttcgattccggagagggagcctgagaaacggcgaccacatccaaggaaggcagcaggcgcgcaaattacccactcccgacccggggaggtagtggcg

SEQ ID NO: 31980 - DNA, 356 bp, Homo sapiens
actgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattgggaaagc

SEQ ID NO: 31981 - DNA, 448 bp, Homo sapiens
gtggctttgcaggatacagcctccttcagctgctttcatggtctggcattgagtgactgtggcttttccaggctcacggtgcaagctgccagtggatctaccattctggggttggaagatggtggccctcttctcactgctccaccaggaagtgccccagtggggactctgtgtgggggctctgaccccacatttcccttctgcactgccctggcagaggttctccatgagggccccgcccctacagcaacgttttgcatgggcatccaggcatttccatatgtcttctgaaatccaggtgggaggttcccaaacctcagttcttgacttctgtgcacctgcaggctcaacaccacgtggaagctgccaaggcttggagcttctatcctctgaagccacagcacgagctgtccattggccctttcagccatggctggagcggctggga

SEQ ID NO: 31982 - DNA, 465 bp, Homo sapiens
cattaaaaatagtacacagattttacacatatttataaataacttgtcaaatgggaccttagtgattcacattcctgagtgaaaagttaaatttgaatattagttaaggaactctgtaaactgatcaaaacttagtaaattttatggtgtgtcagtcatatcttagtagagctgttatttaaaaaaaaaccagcaaaagagaaaacaaacttgttaaagataatactgagagtgagaggggagaaaaatatttcctggtatttttaatggagacaataaatttgaagagctgcccccagtatagagaaagattaaggttgggccaggcgcggtggcttacgcctgtaatcacagcactttgggatgccaaggtgaatggatcatttgaggtcaggagttcaagaccagcctgaccaacatggtgaaaccctgcctctactaaaaatacaaaaattagccatggtg

SEQ ID NO: 31983 - DNA, 461 bp, Homo sapiens
  misc_feature 2, 10, 38, 56, 455: n = A,T,C or G
anttcggccnttatggcccgggccatgagtgtgatccnccattgttaggtgcctgncctagacgagatgaacctgaggtccttgttttgttttgttcataatacaaaggtgctaattaatagtatttcagatacttgaagaatgttgatggtgctagaagaatttgagaagaaatactcctgtattgagttgtatccgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtggagatgtttaaataaaattgtgaaaaaaatgaaataaagcatgttttggntttccc

SEQ ID NO: 31984 - DNA, 476 bp, Homo sapiens
aggacagctctcgaataaaggttctcatgtgagcagtgatggtgcaaccaagagcggaagatcttcacatggccctgtctccttttttccacggcactttgcatgatctgaaactgcttatttattgtttcttctacttcaggagaggagggagtgtgctgtcgtgatcacagttgtattcacagtgcagttgctcagtacaaatttgtgaatgaatggcaccagcttgattttcttcctttgaaggcacttaattttttaataagtttgtaatacaacttttttcctctggaaaaggttctgacatatgtaatcatctctattcattcattttgcttggtaccaggcaacctctttgacttatgggttcacatcattcttgaccttgggtaagttttaaatctttaaacattcttctatttattctgggagttttctttcaaaacaccaattaaagctgtgcactgatgctttca

SEQ ID NO: 31985 - DNA, 494 bp, Homo sapiens
  misc_feature 1, 11: n = A,T,C or G
naattcggccnttatggcccgggggccttcacctgcagccagccccaagcacctgaatattattgatttttaaatctttgttatttagctaaatgaaaaatgctctcttttagtttgctgttcatagtttgctgctcatagcttcttagttcagaatttaatcaaatgattttgttttctttatagattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgt

SEQ ID NO: 31986 - DNA, 452 bp, Homo sapiens
  misc_feature 1, 12, 31, 32: n = A,T,C or G
naattccggccnttatggcccggggaaaganntatgttctctcagtagaaaaaaaaataccttataaaattacatattctgaaagaggattcccgaaaatgggacctggttgacctcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattggagttgtgtgaaagatgtcaaaaaaagattttagaagtgcaatatttatagtgttattttggtttcaccttcaagcctttgccctgaggtgttacaatcttgtcttgcgttttctaaatcaatgcttaataaaatatttttaaaggacga

SEQ ID NO: 31987 - DNA, 466 bp, Homo sapiens
gattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccatt

SEQ ID NO: 31988 - DNA, 178 bp, Homo sapiens
aggaaccagctaagttggttcatctggagaagcagcaggctggcagttatgctgacatttcaaatacaactttatttctgattttggttacaacaaaacgcagtctattactgggcaaagcaaagtaaccaaaattaactctaagaataatgataagtattttttttggtatacagat

SEQ ID NO: 31989 - DNA, 456 bp, Homo sapiens
ccttatggccgggcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcat

SEQ ID NO: 31990 - DNA, 295 bp, Homo sapiens
aaaatagaaatgatgacataattacctatttggctggttttattcatagggagcatcaggtacatgtgcatcacacatctttggttcctcttttttaggtgaatattagactgtttaagtataatttttattgtagatcaaatattttgtgttgaaaaatagctccaacattaattatggtgaaagtcattgtcaaactatattttgttgtataagttttccttttacaagttcatgatgaatacaactgtgaaagctgctattttactgggattttaataaactgttcaatcta

SEQ ID NO: 31991 - DNA, 415 bp, Homo sapiens
gggcttaaagtacattattctatatctttggaagtattgttgtagaactggcaaaaattaaaggagaagaaagaacaacaaaagcattttggaatggataacgaaaaacaggggtaacggtagaagttatacttagtgttagtaaatatagttaataaatatacagtagggccatgtgcgagtgactgtttccatgtcagcatattaagtttgttgacttaataatgctgtgtattatatctgtttctcatttggaaagttgctcaaatttgcacatgagcatagattgaagttagtgtgtccaccctttgaatcatattgttcctgaaaaaggtacaccctgttttaaaagtttactagtgttggttttacttttatttctatcaaaggaggattaaacttatccatggtattt

SEQ ID NO: 31992 - DNA, 465 bp, Homo sapiens
acatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgcctttcagttcttttccaaatc

SEQ ID NO: 31993 - DNA, 467 bp, Homo sapiens
gcttgcgagtggagtgtccgctgtgcccgggcctgcccatgagcgtcccggccttcatcgacatcagtgaagaagatcaggttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggca

SEQ ID NO: 31994 - DNA, 341 bp, Homo sapiens
gtttgcttaaaacctaaaaacttaacatgttgcttttcatgtgctgtgccaagtcttgataatactttttcccccaaccaagggacctcataacctgattatggttattgctttacaaacagttttgacagaaggtggctgctagagcttaacatacgttcccgttccatgtgatggaaccggttcttgcaaactaagctcatcattgattctttgctgaagtcagcaaatagagttagagagatacccagtcatctatcacaccaaataaaaggacataacggctttcaaaagggttttcccacttacccaaaaggctttctgaaagcttctacctctgc

SEQ ID NO: 31995 - DNA, 398 bp, Homo sapiens
attcctaaatcctcttgtctacttttgtcattgaacaatgctctccctctcgtcttccatcctcattcagaatttttagaagaccacaatcgtggagatacactacccagtattgtttgatacatttttatttgataaacattcagtgcaggaaactgtgatttgctatatgtttatgtatataatcttattctgtagtcatcagaatgttaatgtaaggtacatttgatttttattttttacatgtgtagttttctttcttcacagtcaaagcatttatattattgggggtgggggcagggaattaagttggtgggctcgaaaatccattcatatgtatctgtctacaaatgtctggggataatttaaatttgaaacctaagttatatataggtttg

SEQ ID NO: 31996 - DNA, 235 bp, Homo sapiens
gatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgat

SEQ ID NO: 31997 - DNA, 466 bp, Homo sapiens
gctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaac

SEQ ID NO: 31998 - DNA, 388 bp, Homo sapiens
  misc_feature 15: n = A,T,C or G
gtctgctaagtaatntacagggaagtaaggagtcacttttcctggtgaattaccacaattcgggatcaggcttttagttctgcatatctagaaatgtatttacaaaagctaaagacctgagagagcttgtgaatgacacacgtgttaaatatgatacttctgatttccagttctggcaaaattgcggagcacatatcttaaaaagaagacactcttaaaattcatgagtcaagtgtttaactcaagacatagagtcaaggtgtatagaaattgaagaaaagtatatttcataggtgaaatctgcttatatttaagggatatttacaggaaatgtttttctctctctaggaggaattggatgatatctaggtagcaagtcagatttttg

SEQ ID NO: 31999 - DNA, 469 bp, Homo sapiens
ctaattgcactatgttatctttatggtaagcatctattagattcactatactgtatatgtgtgtcagtttaccaaatggatttgcagtgattgacacagatttattaagggagaacaaagaaagctgttagttatattggtggattgagttaataattgagattttcttttctattgattaacaggtaggaaaacagaaaaaagcaacattagtacataaaaatattaaactacctttactattcaacgatagttttcaccaaatgctggcaacatagtcaaagacattcctacaaagcacagcactcgttatttttgttatgagtgaaaatctaatttacatataataaaatgtcaattcacatcataaccatcaagataaatagaaacatttatactcttcgatgagctactctttttgaatttaagtgctgtgcttggctctttgcccagagaccagttgaaatag

SEQ ID NO: 32000 - DNA, 469 bp, Homo sapiens
  misc_feature 16, 23, 459: n = A,T,C or G
aaagaaaagaattttnacccagnaatttcatatccagccaaactaagcttcataagtgaaggagaaataaaatcctttacagacaagcgaatactgagagattttgtcaccactaggcctgccttacaagggctcctaaaggaagcactaaatatggaaaggaaaaactggtaacagccactgcaaaaacatatcaaattgtaaagaccattgacactatgaagaaactgcatcaactaacgggcaaaataaccagctggcatgataatgacaggatcaacttcacacataacaatattaaccttaaatgtaaatgggctaaatgccccaattaaaagacacagactggcaaattggatagagtcaagacccatctgtgtgctgtattcaggagacccatgtcgcgtacaaagacacacataggctcaaaataagggatggatgaatatttaccaagcnaatggaaggg

SEQ ID NO: 32001 - DNA, 237 bp, Homo sapiens
ggatgggcggatcgcctggggtcgggagttcgagaccggcctggtcaacgtggcaagagcccatctctactaaaagatacaaaagattggccaggcgtggtggtgggagcctgtggtcccacctgctcgggaggctgaggcaggagaattgcttcaatctgggaggcagaggttgcggtgagctggggtcgtgccattgcactccagcctgggcgacagagtgagactctgtctcag

SEQ ID NO: 32002 - DNA, 472 bp, Homo sapiens
ggcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagaca

SEQ ID NO: 32003 - DNA, 293 bp, Homo sapiens
agatttaaacctaccgtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattg

SEQ ID NO: 32004 - DNA, 494 bp, Homo sapiens
  misc_feature 12, 13: n = A,T,C or G
cgggaattcggnnttatggcccgggaggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctgtttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatatt

SEQ ID NO: 32005 - DNA, 413 bp, Homo sapiens
gtcaaactttaatatgttttcagtgttctctaattttttggaatttttgtagactttacacctggaaaaaaagatttgtaaaatcaccggaacaattgtgtgctttattttataggtagtggttattagtattacatccccatttaaaaacaaaaacataataatggtcacaacacgtggagttttactaacatacatattaaatcaaagtatattcttaaaagtacttgtgaagtaaaatctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacact

SEQ ID NO: 32006 - DNA, 181 bp, Homo sapiens
cgttgtgatttagctatctaagcaaagtgttttagatgcctattagaccttcaagctgagatatcaagactgttggatatgcaagtctggggtatgaggaagaggtcttaaaaaaaagaaatcagaaagatgaagatccatgtgtgaggtaggcagcacgtgaggtagtaagataatcagc

SEQ ID NO: 32007 - DNA, 126 bp, Homo sapiens
gctctttccggcggtgctcgcaagacgaggcagccatgtcttatcccgctgatgattatgagtctgaggcggcttatgacccctacgcttatcccagcgactatgatatgcacacaggagtatcca

SEQ ID NO: 32008 - DNA, 399 bp, Homo sapiens
tcagtccagtcgccaacttaaatctcatgagtttctgccttctactgaaagaaaaatttgctagtgactcaatcttagaaaaaagaaaatctccttctataaagacctcaaaatttcctgtcaacagctttagtttgtgaaccttaaactcttattgaaaatctatgtttagggtgtaagcagtttatcatgggatcttcctcccccttacccttctcctctttttgggaagtcatccttcacatattgtttggtttcatcctgatgcatctagaggacataagaatggggtttctgaaacagttctcccatgaattaattagtcctgcaacttatagggtttccagagttattgggtaaactacagtttatttccctcttggagtgttataattcact

SEQ ID NO: 32009 - DNA, 500 bp, Homo sapiens
  misc_feature 5, 11, 29: n = A,T,C or G
agganaagaanaccgtctggctaggaganactatcaatgctggcagccagtttgaatataatgtagaaggagtgacttccaaggaaatggctacccaacttgccttcatgcgccctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggccgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccattt

SEQ ID NO: 32010 - DNA, 154 bp, Homo sapiens
  misc_feature 7, 12: n = A,T,C or G
tgtaccncgggnaattcggccattatggcccgggcaccgggtgacggggaatcagggttcgattccggagagggagcctgagaaacggctaccacatccaaggtaggcagcaggcgcgcaaattacccactcccgacccggggaggtagtgacg

SEQ ID NO: 32011 - DNA, 420 bp, Homo sapiens
  misc_feature 14, 15, 68, 292, 296, 302, 330, 379, 399: n = A,T,C or G
ccgggacctcggcnnttattggcccgggtcatttctctacctagtaaaagatgaaagcccttcatttnttttaggcctttgttttttgatccttttgttttccctgctgtaatgagaataattgtttggaaatgtcatattctgtatttatgattctctgagaaatgcttttgtataagtcttaggtttgacattgcagtagttgacatacacggtaaaggataacctagtgacaaatcactgaagatgcttcctttgttacctcaaaaaaaaaaatccagacaaaatagcntttntaaatntagaaaacaggattggctgttttccaanaacttcaagttaacaattcttatgcaaggaaaagttcttaatgctaaanacttgttctgcatgaagganacattctttaataatggaaga

SEQ ID NO: 32012 - DNA, 323 bp, Homo sapiens
ggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacactagaaataccaagggtggagatgctccagctgctggtgaagatgcatgaataggtccaaccagctgtacatttggaaaaataaaactttattaaatc

SEQ ID NO: 32013 - DNA, 443 bp, Homo sapiens
  misc_feature 9, 14, 35, 36: n = A,T,C or G
cagggaaantcggntattatggcccgggaactggnnaagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttct

SEQ ID NO: 32014 - DNA, 458 bp, Homo sapiens
  misc_feature 2, 3, 6, 13, 29, 34: n = A,T,C or G
annacngcattcntcaaggtcttcctccnttccnttacggaattacatcttgatggcaacaaaatcagcagagttgatgcagcctagccctgaaaggactgaataatttggctaagttgggattgagtttcaacagcatctctgctgttgacaatggctctctggccaacacgccctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaag

SEQ ID NO: 32015 - DNA, 198 bp, Homo sapiens
  misc_feature 7, 8, 33, 34, 35, 74: n = A,T,C or G
tgagtanncccctgtaaagagtgagaataaaannntaagcctgtgtttcccccctaagtttttttaaattgtantatttgtatttgtagtaatattcccaaaagaaatgtaaataggaaatagaagagtgatgcttatgttaagtcctaacactacagtagaagaatggaagcagtgcaaataaattacatttttccc

SEQ ID NO: 32016 - DNA, 114 bp, Homo sapiens
  misc_feature 5, 31, 50, 63, 81, 99: n = A,T,C or G
cattncagtctatggtatatgacaatctggntcccaacactgcgcaacgnccagatgaccttnctacgcctgctgtccacngaaggctcccagaacatnacctaccactgcaag

SEQ ID NO: 32017 - DNA, 498 bp, Homo sapiens
  misc_feature 7, 13: n = A,T,C or G
cgggaantcggtnattatggcccggggggttgcataaatttgcgctccgccagccccggacatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacattcagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatcc

SEQ ID NO: 32018 - DNA, 500 bp, Homo sapiens
  misc_feature 7, 14, 91, 113: n = A,T,C or G
ctttttngtacccngggactctcggttcttatggcccgggaattatgggaatcagaattactggctgatggcccctgaggcctgtgtgtancaaaatgacaggacaatcttgnagtaacacctttcccccttgaagagaagggggttttgattgtgatatatacctagtatctaggagtgaacagtaaaagaggagcagttggctaccttgattacaacagagtaaatgaagtactggatttgggaaaaccctggttttattagaacatatggaatgaaagccctacacctagcattgcctacttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagctggcagtgttcctgccccagcatggcaccttat

SEQ ID NO: 32019 - DNA, 500 bp, Homo sapiens
  misc_feature 4, 10, 32, 41, 93, 249, 454, 489: n = A,T,C or G
gtantccctntcagcctgaggtagccaagaancccgcaganctggagagatgtgtcagaaaccttcttaaaaccctcttggtcctctaccgantcttcgggccaaaaacccattgtcaagttctcagatgaataccctgacaaagcagtggaagtatcccaattgagcttcatgggattggtaaatatggcaacgactcttacccgaattttttgtgtcaatgagtggaagcaggtgccccctgaaganccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatggngtgtgccaatgggtgggatctttgctctgaatggngtttgaacatg

SEQ ID NO: 32020 - DNA, 211 bp, Homo sapiens
  misc_feature 9, 19, 28, 29, 43, 52, 54, 62, 86: n = A,T,C or G
atttttgtnccccgggaanctccggccnnttattggccggganatgtctgtntnacaaatangtaaatatatgtgtgtataccccncaccaccacccactagaaaagattaaaaataaagaatacattacctcattcaataatagttgtcaaaagaaatgaaaaaagcagaatagaagccataaaatatgtaaataatagaaaaaaatgac

SEQ ID NO: 32021 - DNA, 145 bp, Homo sapiens
aattcggcccttatggcccgggggttccacagaagctttgtttcttgggcaagcagaaaaattaaattgtaccctattttgtatatgtgagatgtttaaataaattgtgaaaaagatgaaataaagcatgtttggttttccaaag

SEQ ID NO: 32022 - DNA, 350 bp, Homo sapiens
  misc_feature 344, 350: n = A,T,C or G
gttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgttttttttttttnttaaan

SEQ ID NO: 32023 - DNA, 379 bp, Homo sapiens
tatggccgggatctgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaaaatatatatatatatattcttacatgagtaaaaagcaccctctcccagcaatcgtatgccattggtatttgaagagaattcccaaataacccattgctgctgctgctgtttttgatttgtatgggtttttttgttttgtttg

SEQ ID NO: 32024 - DNA, 500 bp, Homo sapiens
  misc_feature 4, 22, 29, 30: n = A,T,C or G
gatnaaactggggcccgggaantatcggnnattatggcccggggggggtttgtgggtgaactcggggtccaccgccccgctgaggaagatggatgaggatgggcttcctctcatggggtcaggcatagacctgaccaagaaactggcagaccctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagcagaacagtacacaagactctggactacaggaaagtgaagtatcagcagaaaatatcttaactgtagccaaggatccaagatatgccagatatctcaaaatggttcaagtgggtgtaccaagtgatggcaataagaaacaaaatgatatcagaaggactagacccagatcttcttgagaggccaga

SEQ ID NO: 32025 - DNA, 350 bp, Homo sapiens
  misc_feature 1, 9, 27, 39, 158, 278: n = A,T,C or G
nggagttcnaacacccagccctgggcnaacatggtgaantctctgtttcctgttaaaaaaatgtttaaggggcctggcaccggtggctcacgcctgtggtcccccagtactttgggagggtgaggcaggaggattacttaagtctaggatttcaaganccagccctgggcaacatggcaagaccctgtctctgtaaaattaaaaaattagcccagacatagtggcacatgctggcgtcggctgcgtaggaggctgaggtagggaaggatttaactcangaagtcaaggctgtagtgagctgtgttttgtgccactgcactgcagcctgggcaacagagtgagtctgtttc

SEQ ID NO: 32026 - DNA, 432 bp, Homo sapiens
  misc_feature 7, 28, 32, 42, 62: n = A,T,C or G
tcggccnttatggcccggggaattaacnagancctcttctcntctggtaccccagtattacnagtgttgaagtaatggtgatgcttattacaacagctatttaggggaatgttacgttgatctcttaaattgtaaacactacaaaatgtcaaaataatgaggactgacacaactttgccttaaagagtactagactggaccttctcatattacgtttaaggaagacttagagtgttcattgatgtttacgattttaatatttctgaaggccattacagtggcctggatatgtgctgaaagccaaacttttaaattttttggtttttttaagcaaagaaatattttaaataaatcctatttcaacactgaaattgttgaaaaccgtctcataacaaaaggaaaaaacattggaatttttgttttaagtggtca

SEQ ID NO: 32027 - DNA, 183 bp, Homo sapiens
  misc_feature 9, 17, 26, 27: n = A,T,C or G
atttttgtncccagggnaattcggcnnttatggcccgggacagtgtggcccgagcagatggctatgtgctagagggcaaagaagttggagttctatcttaggaaaatcaaggcccgcaaaggcaaataaatccttgttttgtcttcacccatgtaataaaggtgtttattgttttgttcccac

SEQ ID NO: 32028 - DNA, 402 bp, Homo sapiens
  misc_feature 13, 16, 23, 28, 41, 42, 55, 61, 65: n = A,T,C or G
gctgtgctggccnccncggagangcccntagagaggcctcnntggattgtaaccnaaagangaanacggttccctttttgtttttttaaaaatgatttttaaatacccgttttttaccacccgttcctctcggtacctttttttaagcctaagtcagcattgtcttcccagtgttaaaggcatcccctcacctctgcattgaacttacgtatcccatgcccaaggaatggaatttcccatccctgagcccagttcagttaggtgtcaattgatacctattttaattttttatgcaatctgatgagatgagctcagatttaaaaatctcaaaagcacgtttattgtaacaagaattgttatgtattaatactgcagttttcaataaagattgacttgtgttgc

SEQ ID NO: 32029 - DNA, 416 bp, Homo sapiens
  misc_feature 3, 13, 21, 75: n = A,T,C or G
gtnccccgggaanttcggccnttatggcccgggggatgtttgaagctaatctgcaaccagcccttctgatggccnatgaaaggacaagtatggagatgaaagctatcacactgagaatagtgggatgtagatagaaagcacctgaattgtgcttctgaattaaccaatccaggaactgctttacctttggactttttgttatgtgagatattctttatattgttccatttgctttgggtatatgtatattgttacttgtagccaaaaagaaacctctcttagtagaaacaaagggagagttaggttattcaaaaattagtatgggacagttgaatatgcctttttctgcgggagtaggtgggggagaaacttaaaggttcacttgtaaaacaataaagtactaaagaaaatgtgat

SEQ ID NO: 32030 - DNA, 500 bp, Homo sapiens
  misc_feature 2, 18: n = A,T,C or G
tncccgggaattcggccnttatggcccgggggaccttcagcagggctgtggctacccatgttctctcgcgccgggtgtcgctgggctgtcggcctggaccttgcagcccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaatttggtgacaaaatcagaggcatactttataggactcattctga

SEQ ID NO: 32031 - DNA, 437 bp, Homo sapiens
  misc_feature 3, 12, 22: n = A,T,C or G
gtnccccagggnaattcggccnttatggcccgggggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggatcttgtactaacttatgatagaatgtatcagaataaaatgtttttaac

SEQ ID NO: 32032 - DNA, 398 bp, Homo sapiens
ggctttccaaaatggcgcgggtgctgaaggctgcagccgcgaatgccgtagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagtggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgaggtggataat

SEQ ID NO: 32033 - DNA, 466 bp, Homo sapiens
agaatatcctgaataagaatggaggagtgatggctgtaggagctcgtcactctttttgacaaaaagggggtgattgtggttgaagtggaggacagagagaagaaggctgtgaacctagagcgtgccctggagatggcaatcgaagcaggagctgaggatgtcaaggaaactgaagatgaagaagaaaggaacgtttttaaatttatttgtgatgcctcttcactgcaccaagtgaggaagaagctggactccctgggcctgtgttctgtgtcctgtgcactagagttcatccccaactcaaaggtgcagctggctgagcccgacctggaacaggccgcacatctcattcaggctctcagcaaccacgaggatgtgattcacgtctatgataacattgaataaccaggctacatgtgcccccgggttccttcctagaaatgtggcagcccattccagcacacaggct

SEQ ID NO: 32034 - DNA, 449 bp, Homo sapiens
  misc_feature 446, 448: n = A,T,C or G
gatcctcaacttagagaggaagaaaccaagacagagagcttaactcacttctctcagggaaaattaggagttgagcacaggacaggaaatgggttttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcgatgaaatgtttcattaataaaaaaccactttntnt

SEQ ID NO: 32035 - DNA, 462 bp, Homo sapiens
  misc_feature 9, 13, 28, 30, 32, 40, 385: n = A,T,C or G
atcggcccnttanggcccgggggagtgnancnaggaaaancaacctaatgtgtacctaggcttaataccctgggtggtaaaataatctgtacaacaaacccccccgacaccgagtttaccctatgtagcaaaccctgcccttgtaccccctgaacttaaaagtaaaaaaaaagtttctatctatgttctaaatttctaaaacttcaactatccatgactactaataaggttcaatcatttattatgacccaaattagctctggttggcttaattgctagaaatcagctttcttctaaatgtgttctccagcaatttttgagactcctcatgaagcagcatttttagaacttttctgtttcagccatgaagaaatgcagttatgtncatggaagttttttttagctttctctttatactttaattattaagcagtaaaattcccttttttgttgacaattttg

SEQ ID NO: 32036 - DNA, 207 bp, Homo sapiens
  misc_feature 18, 19: n = A,T,C or G
gtacccgggaacatcggnnattaggccgggaatttcaaataatcctttttggctttcatcattatccctactagatgttatgtgttcttttgcaattgtttctgcttatacctttactagcaaagggaaaaataacaatttggtgtcaatgatctggtgaaaatagggttacattggagccaattgaataaatttattctttcaatc

SEQ ID NO: 32037 - DNA, 457 bp, Homo sapiens
  misc_feature 4, 14, 22: n = A,T,C or G
ggtnccccgggaanttcggccnttatggcccggggccgggcgcggtggcgcgtgcctgtagtcccaaagttactgggattacaggtgtgagccaccgcacccggcctgtctctggcttttcttccttatctgagttccttcttaggctgccttctctatttccaaggcttcagatctcatctcattgtagaagactcaaatttctgtctccagtccaagcctctgccttaatctccaggccacatttccagctgccatccacacagctgtccttgaagatagcaagagcacttctagtgctcacatcctcaactgcactgtcccctcctttacactgctggtaccctgcagccacacagccaggccagctttccttgattcccccacttctgttactggcaccgccatgctcatggccactcaaaaggcagggcccacagaccatcccccacccctg

SEQ ID NO: 32038 - DNA, 466 bp, Homo sapiens
  misc_feature 4: n = A,T,C or G
aganctgggaaaatacagattggttcaaagaaacaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacct

SEQ ID NO: 32039 - DNA, 220 bp, Homo sapiens
tgaggtaggagttcaagaccagcctgaccagcggggagaaaccccgtctctgctaaaaatacaaaaaaagttggccaggcatggtggcgcatgcctgtagtcccagctactcggaaggctgaggcgggagaattgcttgagcctgggaggtggaggttgcggtgggctgagatcgcgccattgcactccagcctgggcaacaagagcaaaattccatctc

SEQ ID NO: 32040 - DNA, 463 bp, Homo sapiens
  misc_feature 1, 5, 10: n = A,T,C or G
naganaaggngcaagcaaagtagggacattaaagatctgaataacactaacaacacactgacatttacaaaacattatactcaccaactgcaaaatgcaccttcttttcaaatgcacatgaaacattcaccaagatagaccatatgctgggttacaaaataagtctcaacaaatttcaaaggattaacattttaaataatattttatctgaccataacaatacaaatattgataagatgcctagagaatttccaaattctttaaaattaacacacttctaaataatgtaccaaaaaagaaattacaagagaaattagagaatgttttgaactaaataataatgaaaacaaaacatatcaaaatttgtgagatgcaactaaaggttatagctttaaatatctatcttagagagaaaagcttggaatcagtgacctaaattttcagcttaagactctagaaaaag

SEQ ID NO: 32041 - DNA, 481 bp, Homo sapiens
  misc_feature 15, 33, 34, 38, 39, 44, 62, 65, 77: n = A,T,C or G
ggcttctaggtcccncctcaggactagagtatnnagannaaccnaaccccaaacccgcaganganaggaaataaccnagatcagagcagaactaaatgaaacaaacaaacaaacaaatatgaaagataaatgaaacaaaaagccagttctttgaaaagataaatataatttgatagatcattagcaggattaaccacgaaaagagagaaaatccaaataacctcattaagaaatgatacaggagacattacaactgacaccactgaaatacaaaagaccattcaaggctactatgaacaccttcacacacataaactagaaaacctaggaagagatgggataagttcatggaaaaatacaaccctcctagtttaaataaggaataattagataccctgaacagaccaataacaagcaacgagattgaaatggtaatttaaaaattaccaacaaaaaaaagtccaggaccagacagatttac

SEQ ID NO: 32042 - DNA, 480 bp, Homo sapiens
  misc_feature 7, 38, 50, 53: n = A,T,C or G
tcggccnttattggcccggggctttctgccccgtggancgcccgccgaanaancatcgttaaagtctctcttccccctgcccgtcatgtctaagtcagagtctcctaaagagcccgaacagctgaggaagcctcttcattggagggttgagcctttgaaacaactgatgagagccctgaggagcccattttgagcaatggggaacgctcacggactgtgtggtaatgagagatccaaacacccaagcgctccaggggctttgggtttgtcacatatgcccactgtggaggaggtggatgcagctatgaatgcaaggccacacaaggtggatggaagagtttgtggaaccaaagagagctgtctccagagaagattctcaaagaccaggtgcccacttaactgtgaaaaagatatttgtttggtggcattaaaagaagacactgaagaacatcacctaagagattattttgaacagtatgg

SEQ ID NO: 32043 - DNA, 468 bp, Homo sapiens
  misc_feature 3, 5: n = A,T,C or G
gananaagaactgtattttcccttttcctgggagcctctgggctcaagattttgcaggtgtgtcatctgatccatggcttgcatcgatcaaaactgtgccaatgcatatttaattagcaaggggaccctggatgcattatagccatcatccctatattgaatggactgtcagactctccgcacgcttctccacccccaccgtcccctgaacccgtgctccctcccttgcctcgttgtttgggaagcttctgcattttgtctgagcagctaaaaagtttctttgtttttagctgctgatgcatacagcgccactgaggagaatacaaacaagtagagtcctaaagtgtttattttgtctaaggaagacaagctaaaccaatttgattccttcggtaagattttcaaaccctgtagaaaaccgacaagaaaagcaaaaagaaaatgaatacactgttcaactcttcacat

SEQ ID NO: 32044 - DNA, 212 bp, Homo sapiens
taattaataaaataatgctaccagtctactcgcagtagactaccaattcattgcagtttgcctgggactgtcctggtgctaaaattgaaactcatacttcttgggaaactctttagtcctggggaaatcaagttaccccaaccccagtttcttagctaactccttaattatttttggaatatctacagtaaaaataaagcaatggctccacc

SEQ ID NO: 32045 - DNA, 479 bp, Homo sapiens
  misc_feature 444: n = A,T,C or G
gctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagctttcttcgccttcgtcaaatcttcaatggaacctttgtgaagctcaacaaggcttcgattaacatgctgaggatttgtagagccatatattnattgggggggtaccccaatctgaagtcagtaaatg

SEQ ID NO: 32046 - DNA, 280 bp, Homo sapiens
agagcaggcaatccgcaaaatcccacgtgtcatgcaagatagcgcattcaaagatctctgggattaggatgaggacatctttgttgggggtgcaggaggggaagcatctgcctactactacagggggtaccaatttatcattgacatatttagaatctgctttgggctggggcagtagttcatgcctataactagcactttgggaggctgaggcaggaggattgctagaggccaggaattcaagactagtcttagcaacagagtgagatcttgtctctgc

SEQ ID NO: 32047 - DNA, 320 bp, Homo sapiens
  misc_feature 5, 16: n = A,T,C or G
aatancggtttattgntggcccgggtgtggtggctcatgccctataatcctagcactttgggaggccaaggtgggcagactgcctgaggtcaggagttcacaatcaacctggccaacatggtgagaccccatctctactaaaaatacaaaaattagctgggcatggtggtgtgtgcccgtaatcccagctaacttgggaggctgaggcaggagaattaaaggaacccgggaggcagaggctgcagtgagtctaaggctgcagtgagccgagatcgtgccattgcactccagtctgggcaacagagacagacttcatccca

SEQ ID NO: 32048 - DNA, 357 bp, Homo sapiens
  misc_feature 2, 21: n = A,T,C or G
gnttttttgtaccccgggaantcggccattatggcccgggcattaacattattttagtaggagttgcaaaatggtgatttttttttaaaaagattctatcattccttcttcatttatgcagtggaattcctctattaaagataattttctgaagaccagcctgggcaacatggagaaagcccatctctactaaaaatagaaaaattagccaggcatggtggtgtgtgcctgtagtcccagctactcagggggctcagggctcagggagtataacctgagcccaggacatggcggttgcagtgagccatgatcacaccattgcgcttcagcctgggccacagagcaagaccccatctc

SEQ ID NO: 32049 - DNA, 476 bp, Homo sapiens
  misc_feature 21, 22, 27, 28, 68, 73, 442: n = A,T,C or G
gattttttttaccccgggaanntcggnntatttatggcccgggggcagtttgaaatcgcggtgccgancgaangagtaggtggtgggatctcacccgtgggtccgattagcccttttctctgccttgcttgcttgagccttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcggggagaatgaanaatttgggattctctcatcaaggctacaattgct

SEQ ID NO: 32050 - DNA, 416 bp, Homo sapiens
  misc_feature 415: n = A,T,C or G
tatggccggggtggcatttttgagctgaaagcctttaaagattatctgatagcccctactatttgatatgagatgaggaaacgttcttttataaaaaattacctcagtttttatttatatagagatgagaaagataaacatggaagtaaaaagaaaataaattttgaaatacccaacttattaaaatatgatagaattttgttgaagaatataaaatcaagacctgaagaaatggaggtgcgtgatacgttcctagaaacataaagttaatgtcattattaacatgtcagaccaggtgcagtggctcatgtgcgtaatcccagcactatgggaggccaaggcaagtgattgcttgagtccagcagttggagaccagcctgggcaacatggcaaaaccccatctctacaaaaaatnc

SEQ ID NO: 32051 - DNA, 134 bp, Homo sapiens
  misc_feature 20, 33, 53, 131: n = A,T,C or G
gtagttcggctgttcaggangctaaggcaggangattgcttgagccctgggangttgaggctgcagggagccaatgagccatgattttgccactgcacctacagtcccgggtgacagagtgagactctgtnccc

SEQ ID NO: 32052 - DNA, 325 bp, Homo sapiens
  misc_feature 2, 11, 27, 29, 43, 51, 55, 74, 78, 95: n = A,T,C or G
gntcttttgtnccccgggaatctcggntnttatggcccgggantgtaaaancganctaataccagagtatgaanaganctggtaccacctgaaanctgtagaaccagtgatgaaataaattgaagacacaaataaatgggaaaacatccctgtgttttgtggaataacctaatattattaaaatgtccatactactcaatgtgatccacagattcagtgcaattcttgtcaaaattccaatgacgtttttcacagaaataaaaataaatcctaaatattttatggaacccacaaaaggtgctgaatagctaaagcaatcttgagc

SEQ ID NO: 32053 - DNA, 369 bp, Homo sapiens
gggatggtgacttttgaagaacaaaagctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttaagtgtttaga

SEQ ID NO: 32054 - DNA, 243 bp, Homo sapiens
  misc_feature 8, 17, 25, 26, 29, 30, 56, 174, 178, 184, 213, 222: n = A,T,C or G
attttgtncccgggaanatcggccnnttnngcccggggggtgtggcctcctttgcntttatatatatatacacacatgtgagtctggctgggctggtattttgtttgatcttcctggaaatgagcagtgactaaccgctcacataactggtttttttttttatctgggctgatnaatncatttncctaaaaaactcatttcgttttacttaanaggggaagngcagttttcttttggcagttc

SEQ ID NO: 32055 - DNA, 491 bp, Homo sapiens
  misc_feature 13, 414, 479: n = A,T,C or G
tatggccggggantcttcccctctctaaacccttctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggggnctgccagcttggggccctccctgtcgccagtgggcacttttttttttccaccctggctccttcanacacgtgcttga

SEQ ID NO: 32056 - DNA, 471 bp, Homo sapiens
  misc_feature 15: n = A,T,C or G
agtctaccatttttntaataagaggtaccctacttagtgttttctggtgctacaagtttcatttgcaaaaaaggagaaaagaaaataagaatagtgtctcatctgcaacttcagctgttagaatatatttacaataaattacagactatttgaaagacagctagagcccaacccaagccaagtttacatttagctgccaggagaaaggaaaatatttgagaatattaacatatttaaagtgtgtatcatccatagaaatcatctgaggcaaactaccaagtaaataactaattaaataacaaatgaatcaaaacatgtttctaatcatgggtgaagaggatgagtagaggaaacaactgttaggtgctgaggttaaaaatgtatatatgtgtataggtttagctgaatgttataggctggggagtataagaccaaacaggaacccttgaaatggaggaatatgctgcaagg

SEQ ID NO: 32057 - DNA, 312 bp, Homo sapiens
gttctgcctttgttttaattttaactcatgttcatcctgccctatggttctctagccacctgtgcatgcatgtgtatttctgcctggttctatggtgtgtggatgtgtgtgcatgaatctgtcatatagagggggtccgagctggaatcctagagcattgctgccctggggcctgatgttcttggcttcctcagagcatgtaacaggaaattaaatgggatgagtgtttggtgtggtttgtgtctgatgagttttttaacattcaggtgtagattgtttcagcttctcatgtttcattttcctgaagattta

SEQ ID NO: 32058 - DNA, 132 bp, Homo sapiens
  misc_feature 92, 116: n = A,T,C or G
acctttcctgatgtcagtggctatcaattctatagctgaaaattagtgatagtttgggtctcatttatgcataagattaattgaaaatcagnaatggccaggaagaaatatgaatnttcaaaccactttttt

SEQ ID NO: 32059 - DNA, 364 bp, Homo sapiens
  misc_feature 5: n = A,T,C or G
cagangggaatgaaggacagaaacaattaggttattacaagacagaataaatcaaagctagaagaagaagtggtcaggaagctatcatttcgtaagcacctgctagggtggaatacttctgtgactacaggagccaggcagcatgacattctgggtgggtgatgactggagcttgtatttgtccctttgtcacagtccccaccattccacagtatctctctaacaaacaactgatgaactgaagactgtttttaagaaacaagagttttttatgttattgcaaatcttagcttaatgttgtgttagattgcttgggaatggtggggaacctgtgagccagaaaaacctatgcttttctggggga

SEQ ID NO: 32060 - DNA, 498 bp, Homo sapiens
  misc_feature 6, 8: n = A,T,C or G
tcggtntnttaggccgggagtagtaataattataaaagtaacattctttaaagcaaacacattgaaaatattattacaggcagaaccctgatttttaatttatattccctgctgcagacattagccttctttaattcttttgccattacatacatgtttcggctacagactgaacacgaactaaagtccctaaggaggaaaaaaccttaacatattcctgagatgtgattcttttattacttctttttgcaaagctaattatcaaatgatttgattaaacctagacgcattaggaaatgcaagttttacctaaaacttgcagaaatttaaacacatttccatttacttactaacgaacagacctgatttttatttaaaaacacaatttagctttgccaacagaagagtaaaggaaaccataacttataaatttgtaaatggtgttcctccttgttggagacattagccagtgttttagtttttaagaccaacttatac

SEQ ID NO: 32061 - DNA, 129 bp, Homo sapiens
  misc_feature 2, 21, 28, 29: n = A,T,C or G
gnttttttgtccccagggaanttcggcnnttatggcccgggggcagacaatggaacagacaaagcctcatttttatgagcttacgttctatggaagatgacaaagcagataagacagaaaatatatagt

SEQ ID NO: 32062 - DNA, 169 bp, Homo sapiens
  misc_feature 8, 169: n = A,T,C or G
catccgangggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcn

SEQ ID NO: 32063 - DNA, 395 bp, Homo sapiens
  misc_feature 2, 7: n = A,T,C or G
anctaantttgctcgaaccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaaagtttggtaaaattcatacttaataaacaatttagggacagac

SEQ ID NO: 32064 - DNA, 365 bp, Homo sapiens
gggggaagcggcggcaggcgcccatgtccggccgcgaagtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagttgttgtcttggagcctgttgtacattttaagaataaacttttg

SEQ ID NO: 32065 - DNA, 211 bp, Homo sapiens
atttcaaaatagctagtagagaataacttgaatgttcctggcataaaaaagataaatatttaagttgatggatattccagttaccctaatttgattatatgaatgtgccaaattattattactttcacaccaacctaatatgacatgtacattgagtatacatatatctaatatgtatcaataaaaatgactaaatacgtaaagataaact

SEQ ID NO: 32066 - DNA, 359 bp, Homo sapiens
  misc_feature 11: n = A,T,C or G
ggaggcgtagnacaaaattgaagctctacaaaaccatgaaaatgagtctgtatataaggcttcattaagcttaactgagaagtatttctctgtagaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcaccaccgctggcccgccactgcggatgctgtccttatccaccacctcctaagatagttcgatattagggtagcagttacaaaagcgagccacatctgtaatctggctgtcagtcagctgaaga

SEQ ID NO: 32067 - DNA, 383 bp, Homo sapiens
attctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatg

SEQ ID NO: 32068 - DNA, 251 bp, Homo sapiens
  misc_feature 22: n = A,T,C or G
ggacaaaccaatgaaaacaagnagggaaagtgagaaagatcacccatgattctgtttcactgtttgctttctcctgtcatggttaagagaaatgtgcaattcgatcctcaatcagtgggtggaggataacagggtagattcacttgtgtgcacttgtacagttgtagctgcgagtccagaagtcctctagagcatgtgtactggcactgagttggtgagacagttgtggagtatcccattctgatgagtac

SEQ ID NO: 32069 - DNA, 149 bp, Homo sapiens
gatggtagtcgccgtgcctaccatggtgaccacgggtgacggggaatcagggttcgattccggagagggagcctgagaaacggctaccacatccaaggaaggcagcaggcgcgcaaattacccactcccgacccggggagatagtgacg

SEQ ID NO: 32070 - DNA, 333 bp, Homo sapiens
ggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctgcattgcttggtagtcttcatgtaaggctcagctttattgtgtgtttttaggatattatcaactcactggtaacaacagtattcatgctcatcgtatctgtgttggcactgataccagaaaccacaacattgacagttggtgga

SEQ ID NO: 32071 - DNA, 407 bp, Homo sapiens
  misc_feature 20: n = A,T,C or G
ggttccgtggaaggaacagnaaacaagcacttgggcgtgggttgtgactgcttttgggggagcctggggtttgggctcccacctgtttacagacctttttttctccttcagactttaaaattttaaaaatttaaaaaggaattaaaaaaaaagacttccgtcgtaaagaaacctatttcagaatgcagatgcgttccttcagagctctgggacgggacagtgttgttccctcggccatcgtcgtggactctgtcgattgctttcgccccttcgtcaaggtgacaggcgttgtggccactgtcttgcacatgccggacgcgctctcaggaaagccagggctcccgagggcagctccacaccatttcatgtatttttaaacccaactcctagcactgaagatgttatct

SEQ ID NO: 32072 - DNA, 341 bp, Homo sapiens
  misc_feature 6, 10, 11: n = A,T,C or G
aagaanaganngttggaggtaggattctcaacacatcttacctccactaatgtcagtggggcccagtggagaactgagccttcactcccatctggcaagtgatgggtggcagggctagttggcattctgcttccttctctaccctcccctgttgttagctgggtcctttggggagctgagcttttggctttatagtgcagcaacaaagaagtttgagtcagccctctgctttcctcctccctgtcatcagtggggcccagcagggaggtgagcttacacccctactcagaggcagtgaggtgatacttgggtttggtgccctactttcattgggactaaga

SEQ ID NO: 32073 - DNA, 172 bp, Homo sapiens
  misc_feature 78: n = A,T,C or G
catatttattttctacagctgactgctgtttataatacccaattaaaggtgtcgatattttgagtaagcttattctangtaattttcctaaatatagtaactgcccattatagttgaatagaatctgctttattttctaagtttaagttaaagtattacctttttttgtcgt

SEQ ID NO: 32074 - DNA, 256 bp, Homo sapiens
  misc_feature 256: n = A,T,C or G
tcattctcattggtgcgggaaatagctctcggactctcaactggaacctggttatctaggtgagcagcaatgctttggcgagcctgggtccccatgtgtaaaaaacgcccagggtccaacttatggatcctagagataagccttgttattcctttcagcatcatccttgcacgtgagtcgaggactagttctccagcctaggcgaccgacacacgctgcctggggccggctccaaagcgcccgtcctgagactgcn

SEQ ID NO: 32075 - DNA, 170 bp, Homo sapiens
  misc_feature 28, 168: n = A,T,C or G
gagggttttggcctaggtaacggggcanagatgtggttcgagattctccccggactctccgtcatgggcgtgtgcttgttgattccaggactggctactgcgtacatccacaggttcactaacgggggcaaggaaaaaaggggtgctcattttgggtatcactggagnct

SEQ ID NO: 32076 - DNA, 373 bp, Homo sapiens
  misc_feature 11, 16, 25: n = A,T,C or G
aaattcggccnttatngcccgggcnccttttggctaaccttcgtgtatagatttcataccttatgttgtctttcctgggtacagatttattactgaacaagtacgtgtaagtaaaatgtcattggtgagcaggacacaagataaaaggtgaacaccacatatggtgtgaattgtaaatgcttataccacaaacttgaaaatgtgtcatgtagagccatggaaaatgtctagttgtttttatgtagtacacacattttaatggtgctaacaacctggactcttttgttcatagagttattctgaaaaaaatttcataaaagacactgcctaaagataggtagaataaggctgtagccttgatttactgtggaat

SEQ ID NO: 32077 - DNA, 304 bp, Homo sapiens
  misc_feature 40, 53, 91: n = A,T,C or G
tgtgttttctcagtgccagtcggtagccaagtgcctgganaaccctccagccnccttcccaggggctttggatctaggatcacggtggggngatggtgctgggcaaagagctttggctccattcccttgccccttgcttgaggaaaagagaaatctgatgttcttcttcccttcattcaagtcagaggaagtaatgctgagacccaaggtctagtcaaggattctgaagtagtagaaaaattgacaaagtggacccgatacataaagtggctttgctcacagggaagaactcagttaacatagc

SEQ ID NO: 32078 - DNA, 339 bp, Homo sapiens
  misc_feature 6: n = A,T,C or G
aaaaantaaacctattttcaatctacaaagaataaacgaattacccctcattagacccttgacaaaagaactactaaaagatatatacatcagtaagaagaaaagtgagtcctggaggaaggcgtgggatacaagaaactacggtaagcaaagaaattgataaaacatattataaatacaaatgtttgagtttaaaaacctaaattttaatgtttaaaaccaaagtagtactaaaattctagaaaacaatagcaggaaatcagaaggatgtgttaggagagtttaaaagccacgctagagtctttttgtttgttgttcaggagggagaaggtactgaat

SEQ ID NO: 32079 - DNA, 383 bp, Homo sapiens
  misc_feature 3, 4, 34, 361: n = A,T,C or G
ganntagtataagtattgggaagaaggccaagancacagagaccattatatatgtgtattttcatatatatatatattcttttaaatcactgtgaaaatgggagctctaaggctgtgaagtcatcctagagccactccttcctcctaaaagtacagaaaaactcatttcagttaaggggaaaaaaagagtaagtgagccaggattacagtccaactccagtcaaagttagtataagaaataagagaataaatagatcaacatcctcacagacaatgaaagcacaccggaaggacatgaccacaagacagataaaaacctaatatttgccaaaaaataaaatgcaaatatgacaggaaattntattaaattaggtaccagttat

SEQ ID NO: 32080 - DNA, 382 bp, Homo sapiens
  misc_feature 2, 3, 57: n = A,T,C or G
anntacctggatctatgctgctatgggtggagaatcaacatcctttgaaactggccncaggcagagctaagaggatgactaaaaggtcccttgggtgggtgctaatgagcagggccccaggaaaacctctgtcttcccggagagccctcttgcatgagtttcggctttgccaagattccagggacttgaggacagctattgagttatgggttacgtgactgccacattggggcttggaggcatctggcagatggttgggaatgggctggcaccacactaattaggccacgatgatccagtttgactcagggaaacccagaagtcatagtgctctttgcagaatgacacaagatgtcaacatgctttgttgtgtactttgaac

SEQ ID NO: 32081 - DNA, 349 bp, Homo sapiens
  misc_feature 5, 11: n = A,T,C or G
agagnttgagnggaaagactgttaaccccatccacgcccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatgtgcctctgggcaaagaagcagagctaacgaggaaagggatttaaaggagtttttctttgggtggtttgtcaaacttttattccctgtctgtgtgcaga

SEQ ID NO: 32082 - DNA, 310 bp, Homo sapiens
agggagagagagaaggagaacatcctttatgatgagtcgccagtaatcacagctgtgacatgagttcactatgctaataatctaaattttccttccccatagtatatacatcctgcagatgctgtgaagctgggccaggctgaactagttgtgattgatgaagctgccgccatccccctccccttggtgaagagcctacttggcccctaccttgttttcatggcatccaccatcaatgggtaaggtactgtgggcaggagtccttactcccgtggcaggctcttgcagattcaggggcatgtagtggatg

SEQ ID NO: 32083 - DNA, 110 bp, Homo sapiens
  misc_feature 92: n = A,T,C or G
ctagctgcgagaattaatgtgaattgcaggacacattgatcatcgacacttcgaacgcacttgcggccccgggttcctcccggggctacgcnctgtctgagcgtcgcttg

SEQ ID NO: 32084 - DNA, 267 bp, Homo sapiens
  misc_feature 5, 9: n = A,T,C or G
tggantgcnagtggtgcgttccttggcacactgcaaccctccacctcctgggttcgagtgattctcctgccctcagcttcccaagtagctgggattacaggcatgccgccaccataccccagctaatttttgtaattttagtagagacggggtttcaccatgttggccaggctggtcttgaactcctgacctcaagtgattcggcttcccaaagtgttgggattacaggcatgagccacagcacccagccagcaatggattttcttt

SEQ ID NO: 32085 - DNA, 373 bp, Homo sapiens
tgaagtcctgtagtattttgtagcacttgtctgctttcttgtcttagagatcttagtaaatgcttctaaattgtaaaacttttcctgatcctccaaccaaacctagttatgcacccatgtcacagccccagaatttgtgttaaaccctgtgtgagttgctgaatataaatactgaaatctctggaatccaaacttcatttactttgtggtggagagagagtggctgagtacttcagaactctttagaacacctgttatagcaggaacttttgggaataaaaggtggtctttctaaccttgatttaaaacaaaaacaaaaacaaaaccttgtttagattacttttacttacctgacagtcaggttgtgaaaagt

SEQ ID NO: 32086 - DNA, 260 bp, Homo sapiens
  misc_feature 7: n = A,T,C or G
tggagangccacagatccccccaaggtctcccaagcctaccgtcccacagattattgtacagagcccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaat

SEQ ID NO: 32087 - DNA, 500 bp, Homo sapiens
  misc_feature 13, 19: n = A,T,C or G
tgctaatgaagantttaangtctttttaaggaaatgaagggctttccaaatagaatgatttactctgaagaaacaaacaatggtatctctgaaactcacaacctaaagccccaatcttgaaaatatgttgtgcacccaagacgactgcttcagcttcttctcttatccttactttctttaatagatatttattaaactgtccagtgaaaaggtgccacgatgcccagtattgtaaacaacaggtttgcattcatgaagctttcattcattctggagtctactaatttacctgaatgggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatctttgtctgtatcgcccgtgtgctcatcactgaagaattgcaggccactc

SEQ ID NO: 32088 - DNA, 251 bp, Homo sapiens
  misc_feature 1, 11, 30: n = A,T,C or G
nccccaagtanttttaaaaaagtgtgcccncccttttaaccctttacctttttttaagttgaaggtgatacctttttctatatatgatgaaacctcatgtcaacctgaagtgagtgtaatctcagatatcaacattattatattttaaaatcacgcctatggaaatatcaccctgaattctgtcatttgtcagatttacagtacctttttttctttaacttttagcattaaataaaaataaaattgggagc

SEQ ID NO: 32089 - DNA, 263 bp, Homo sapiens
  misc_feature 4, 7, 12, 68: n = A,T,C or G
ggantanttaantttaaaggcctcctacttgtaaccaaagggtttttagccattggtatttttattantgggtctcctttaggggaaaaaaaaatgcctataaacctgcaaatctgaaattcaaatgtgttgttcccactgagacccagaagaagaagagggagttttaaaagggataatttgttggagccaataaagctttttgctgatgaacagaaaccaatactgctgtgcacttgagaataaaaactcatgcccacttt

SEQ ID NO: 32090 - DNA, 439 bp, Homo sapiens
  misc_feature 147, 179, 230, 259, 276, 399, 425: n = A,T,C or G
acacacacacacacacacacacacacgtgcacattcctcccttacatgctcatttgtgccttaaatgtgccttataggtaaatccaggatgactgaggaatccctcgtcactgggagattttgtatatattcttttattattagatngagttgggtgtggggaaaaatttttttctganggctcaaaagtggtttcctaaaagtgagccactatcagatttgcacatcangagaaaagaaatagggttacgtccattangaaaatcccagtttgcnggagtgcaatcacatcaaaaaaacaaccagccaggattaaaggtattataaatcctcatagcggaacatttctcagggcaaaggaacctggctcatttgaagattaatgttccatgcctttgnggtcaaacggtcagcacttaacacangaaaaaactaggtg

SEQ ID NO: 32091 - DNA, 199 bp, Homo sapiens
  misc_feature 9, 10, 27, 36, 37, 38, 40: n = A,T,C or G
ctccggccnnttaatgggcccgggganctggttaannntntttaaaataaaacctgctgtgggttttcacatgattgctggatgccttattcatgggcctggagtaatcatgtaaaacccatgcccacagacccttgagagaacataattaagtatttcatatgttcagctttgaaagctcattgttaagtgttagccc

SEQ ID NO: 32092 - DNA, 260 bp, Homo sapiens
gggtataaaagaggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattc

SEQ ID NO: 32093 - DNA, 166 bp, Homo sapiens
gttctccctgagagagattaacctccctgagatcaaccaaggcagatgtgacagcaagggccacggacccctgctccttcggaggacgtgccctcacccctcactggtccactggcttgagactcaccccgtctgcccagtaaaagcctttctgcagcagctgaac

SEQ ID NO: 32094 - DNA, 125 bp, Homo sapiens
  misc_feature 4, 20: n = A,T,C or G
attnggccggggtgggaagngaaagtgtgttcccggcatgaggtgccctcggaattagtaaagaattgtgggcaatggattaacccactgtatctaagaatccaccaattaaagcatttgcacag

SEQ ID NO: 32095 - DNA, 226 bp, Homo sapiens
caaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctct

SEQ ID NO: 32096 - DNA, 496 bp, Homo sapiens
  misc_feature 16, 21, 31, 50, 60, 78, 92, 112, 123, 135: n = A,T,C or G
agccttaaatatagcnagganctaacccctntaccttctgcataatgaanttaactaganataactttgcaaggaganccaaagctaagaanccccgaaacccagaccgaanctacctaagancagctaaaagancacaccccgtctatgtagcaaaatagtggggaagatttataggtagaggcgacaaacctaccgagccctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactatg

SEQ ID NO: 32097 - DNA, 106 bp, Homo sapiens
  misc_feature 2, 5, 35: n = A,T,C or G
anttnaattaatttgttctagtgctttcaagagcnagtacatcaaaatgtagaaggtaaaatgtatgcaacactaatataaattattccaagtctttaaggagccc

SEQ ID NO: 32098 - DNA, 469 bp, Homo sapiens
ggctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacatcgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaacca

SEQ ID NO: 32099 - DNA, 394 bp, Homo sapiens
  misc_feature 18, 30, 49: n = A,T,C or G
tatggccgggcatttganctaattcgtttnctggggattcataagagtnccttaggggcctgtatgtcagaatttgaggtgtgacttactttggagcccttcaaggcattatttaattatttggtaattcatttttctatttgtctgctaatgaacatgagtttacactttctgagaaattaccgataccaagactgtagttacacaaagaagttcaatgatttccttaggctaggtgggcataggatggtgttgactgcagatgggcgtgagaaaacctttttcagaacatggaaaggttataaaatacatcctgattgtaagtggtgcacatattgccaaaactcatcaaagtatacaattaaaactgacatatttcatattatataaatga

SEQ ID NO: 32100 - DNA, 186 bp, Homo sapiens
  misc_feature 4, 15, 186: n = A,T,C or G
attnggcccggggantttggattcccgtgtgataggcaagttggttcttgaggaaagctgtgggatgatgaaagtgagtcaggcagcaggctgtaaattggattggacggagggaaagattagaggcagagaaactagccaagagactgtttcagttatcgggcccaggccaagggagtagtggcn

SEQ ID NO: 32101 - DNA, 229 bp, Homo sapiens
gacattctttggtttcagattctttcaacaaagatgttagattttatcctaagaattaatatggcctacaaggctctggaaattctggacccttgtttttttcttagccatgatgtatcccttcagttaaggatctaactctaccttttttctgtttctgactagaacttcgtccacagcttcatcctagtcatagccgtgcttctgctttcaatgccttgcctatgcc

SEQ ID NO: 32102 - DNA, 328 bp, Homo sapiens
  misc_feature 246: n = A,T,C or G
cctttgagccctgcatcagttcttggttttgccctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaactaaaaaccgtggtcaggttcaattgtactttattattagttgtgtatngtttattgctataagaactggagcgtgaattctgtaaaaatgtatcttatttttatacagataaaattgcagacactgttct

SEQ ID NO: 32103 - DNA, 332 bp, Homo sapiens
  misc_feature 3, 5, 326: n = A,T,C or G
aananttggggaaaaaaatatttaaccattaaagttaagaattgtagtgtttattttgcttatggttatttaaattggataaacctcatctgaaatgttgctttgtagttcacattgagtgtgaatagaaagttctctcctgaaaaatgcaggtaaagacaacaccaaaaagtatatagactaagtagatttctgtactgaaaatattactacctgccaccccactttaaaaattcagaactttcatagctgacgtggtgttgggcacctgtaatcccagctactcaggaggctgaggcaggaagaattgcttgaacctgggagangggaag

SEQ ID NO: 32104 - DNA, 500 bp, Homo sapiens
  misc_feature 2, 3, 32, 33, 34: n = A,T,C or G
gnnttttaccacatatgcgcacctatagttgnnntggatcggggcctctttcccttacggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccat

SEQ ID NO: 32105 - DNA, 296 bp, Homo sapiens
  misc_feature 8, 15: n = A,T,C or G
cccggganttcggcnttatggcccgggggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgc

SEQ ID NO: 32106 - DNA, 329 bp, Homo sapiens
  misc_feature 3, 38, 319: n = A,T,C or G
gancttgggccctgttcaataatacttcacagaaaccnaaatgccaaacggaggaaataagtaagccctcccagtttctccaagataaagctttttttattattgctattaatattaaatataggtctcattcatacagtgtatgagtaggatcatttggacaattgtccacaaagaccaatttttaaaacattttcttgtgttatagttaaatagtctagtaatgttttgtcctttattttcaatatttgataaacatttgatgttcaaaacttagctaatagatgcttgtatatgaatgtgttgtaataaagtgganggttttcttg

SEQ ID NO: 32107 - DNA, 152 bp, Homo sapiens
gaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcga

SEQ ID NO: 32108 - DNA, 359 bp, Homo sapiens
gaatcatctatcctttacggcaagggtacctacggtaccctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggaaggggaagtgtgacctgcgacgcccaatgtaagaagtatgacaagtgctgtcccgattatgaga

SEQ ID NO: 32109 - DNA, 380 bp, Homo sapiens
  misc_feature 2: n = A,T,C or G
anctgtaaaatataacctttattaaaatttgcaatctgtctttctataaattattattccctaaatgtgtattttatgttaatttaactacctgaatatttattttgtttaaataaggaggcagctgtctaagaatttttgttaatattactttgtaaattgcgtaatgtaatttattttacattatgtacatttcctttttaacgcacaaaatgtctatgtacaattaactacagatttgcaaataatgtcactaagctttattcagtcaatacagatggcatgtgaagatgtaatatgcttttttacattttcatatgggttatttgtaaataactatattgctgacaaacataaatacggaaatcattttcattcca

SEQ ID NO: 32110 - DNA, 377 bp, Homo sapiens
aaatctctctatagcaaagagtagcagttaggctctgagtctctgcaccgatagaactgaacctgtatattggcttcagacttatcaagagactctggagaggttagttaaccacgtaaatcttgattactctgtctgtaaagtggagatcacagtacctacctcacaggattataatgagaattaaatgaaaatatgtatataaagcactcagctcaatgtcaaagcatgtggcacaggcttggtaaatggttgctgaaaaaagtcagtgcagcatctcttccagtccctcctgggtactggtgagatgaagtaaggcactatcagtatttttggtacactttatacaggagtggggacagtaaatagtatttaga

SEQ ID NO: 32111 - DNA, 327 bp, Homo sapiens
gtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgaagtttgacctgcccagcgtgtgggctggctcaatgctgaataagtg

SEQ ID NO: 32112 - DNA, 372 bp, Homo sapiens
gtctgtggactgttcaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtaccatctgcgggtcaccacggtggcttcccacacttctgactcggacgttccttccggtgtcactgaggttggtcgtgaagctctttgactctgatcccatcactgtgacggtccctgttagaagtctccaggaagaaccctaaatttatggaga

SEQ ID NO: 32113 - DNA, 372 bp, Homo sapiens
  misc_feature 9, 14, 234: n = A,T,C or G
ctccggccnttatnggcccgggttgttaacctcatttagttttattgattcctttaagaaaagtaatgttaacaaactaattttcctggtaagggaactgaggctcagagagtttaagtaatttgcctaagttcatatagttggaaagtgatagagatggggtttgaactcaggaagtcaggcttgcactgtgctcttttgcaaatcatgtcgaattctgaattatgtatttgngggttgtttcctttcacttatggagcagctaaatagaaattaatgcttattaaatttactcaatattttatcactgaatccagacctctaaaaacagctttatccaaaatagcacatttggttgtagctataagaagg

SEQ ID NO: 32114 - DNA, 427 bp, Homo sapiens
  misc_feature 416: n = A,T,C or G
atgtgaattaaactctttattgcaaatcccctgtcttgatgaattagcagtatctggacagtgggcaaagtgaacccattggcaattataaatgactcctgtacttaaaatttttccatggctcctatgaagtggcagtggtaatggatagcgatgatattttcaagtaaaccggattttaaagtaaattgcattgggattttaagaatttttactattaaagtctccttttacttccttttccagtaatatttgctttcattttcttcctttgttttcagtttgtcaaagccataaaaaatagccaattaagttttctctgtaagagtgaagtaaagttaagaggcctggcgctgtgactcacgcctgtaatcccagcactttgggaggccgaggctagtggatcatgaggtcanggagttcaaga

SEQ ID NO: 32115 - DNA, 322 bp, Homo sapiens
  misc_feature 22: n = A,T,C or G
ggttcgtttggtgaattaactngtgagttaaccaccattaacgatggttaaggacacttgggcgctggctcgatttgactccgagctttaccgattacttgtgtgactttgtgcaagttaattaacatctcagcttgttttctcatctgtgaaatggggatgatactagcatgtacctcctaggactatagtgaacttttaattaagataattattgaatttaacaggtagtttattaatgaaatttacataggtaattggggccgcagtgagcccaggggctcaaggtgttagcagtcatcaacagtgctatttgaaactg

SEQ ID NO: 32116 - DNA, 426 bp, Homo sapiens
aagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacggggaggctgcacccactccatgttacttctgcttcgctttcccctaccccaccccccccataaagacaaaccaatcaaccatgacaaaggaagttgacctgaacatgtaaccatgccctaccctgttaccttgctagctgcaaaataaacttgttgctgacctac

SEQ ID NO: 32117 - DNA, 173 bp, Homo sapiens
  misc_feature 5, 15: n = A,T,C or G
gggcnataaaatacnaaaaattagctgggcgtgattgtgtgtgccctgtagtcccagttactcgggaggctgaggcatgagaatcgcttgaacccaggcagtggaggttgcagtgagccaagatcacaccactgcactatagcctgggcaacagagtgagactctatctcaac

SEQ ID NO: 32118 - DNA, 462 bp, Homo sapiens
gggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggattcgaagactaaagaaaaacgtttgtccaatggttctatagactcaaccgatga

SEQ ID NO: 32119 - DNA, 236 bp, Homo sapiens
agcactttgcaaggcttaggtgggtggatcacttgagggcaggagttcaagaccagcctgaccaacatggtgaaaccccgtctctactaaaaatacaaaattagccggggttggtggcacatgcctttaatcccagctactgtagagggctgaggcaggagaatcgcttcaacccgggagacaggttgcagtgagccaagatcacgccattactctccagcctgggcaacaagaac

SEQ ID NO: 32120 - DNA, 290 bp, Homo sapiens
ctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgcaataaaatagtatactgggactgtgcatcaaagggatgtaaaattacagtattccaaaggttg

SEQ ID NO: 32121 - DNA, 348 bp, Homo sapiens
  misc_feature 1, 12, 28: n = A,T,C or G
naattccggccnttatggcccggggaanctggctgcagtgggctatgatcgcacccactactctccgcctgggtgacacagcaagactctgtaaaaaatgaagaagaagaaagaagaagaagaagaagaagaagaggaagaggaagaggaagaggaagaggaagaggaagaagaagaagaagaagaagaagaagaagaagaacaggccatgtgaggttgccacacctgtaaccctagcacattgggaggctgaggtgggaagatcacttgaggtcaggagttcgagaccagtctggccaacatggtgaagccctgtctctagtagaagtacaaagattggtcaggtat

SEQ ID NO: 32122 - DNA, 301 bp, Homo sapiens
aaataatctgaaggagatcaaacatctgtaaggacaggtacccagtgatgataatatatctgaaaacacaagccatttttattctttatcccaattaacttgaggtactctgatgatgaagcactcgattgcactatgacctccttgagtgatgtgcagcttggttcctctctcactttttgtttctttttaatatgcaaatgtgagtgtgcgatcttcagtgtgtctgcataagctaacttaagatgaatttaagtacagttttctgaaatatttctattgaaataaattacttaaaact

SEQ ID NO: 32123 - DNA, 354 bp, Homo sapiens
  misc_feature 12, 15: n = A,T,C or G
ggatcccaggcnganacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaag
